United States Patent 12,508,308 (INFLUENZA mRNA VACCINES) - sequence listing, part 26

SEQ ID NO: 97147 - RNA, 1701 nt, Artificial Sequence
  derived and/or modified sequence opt2 from hemagglutinin__InfluenzaA__ADM14948
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacucccgcaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97148 - RNA, 1695 nt, Artificial Sequence
  derived and/or modified sequence opt2 from hemagglutinin__InfluenzaA__ADM14966
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccggccacuccugccgcaucugcaucuga

SEQ ID NO: 97149 - RNA, 1701 nt, Artificial Sequence; identical to SEQ ID NO: 94361
  derived and/or modified sequence opt2 from hemagglutinin__InfluenzaA__ADM14975

SEQ ID NO: 97150 - RNA, 1701 nt, Artificial Sequence
  derived and/or modified sequence opt2 from hemagglutinin__InfluenzaA__ADM14985
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaaggagaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97151 - RNA, 1701 nt, Artificial Sequence
  derived and/or modified sequence opt2 from hemagglutinin__InfluenzaA__ADM23841
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97152 - RNA, 1701 nt, Artificial Sequence; identical to SEQ ID NO: 95345
  derived and/or modified sequence opt2 from hemagglutinin__InfluenzaA__ADM23843

SEQ ID NO: 97153 - RNA, 1701 nt, Artificial Sequence
  derived and/or modified sequence opt2 from hemagglutinin__InfluenzaA__ADM23844
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97154 - RNA, 1701 nt, Artificial Sequence
  derived and/or modified sequence opt2 from hemagglutinin__InfluenzaA__ADM23845
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97155 - RNA, 1701 nt, Artificial Sequence
  derived and/or modified sequence opt2 from hemagglutinin__InfluenzaA__ADM23846
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97156 - RNA, 1701 nt, Artificial Sequence
  derived and/or modified sequence opt2 from hemagglutinin__InfluenzaA__ADM23847
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgucggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97157 - RNA, 1701 nt, Artificial Sequence
  derived and/or modified sequence opt2 from hemagglutinin__InfluenzaA__ADM23849
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97158 - RNA, 1701 nt, Artificial Sequence
  derived and/or modified sequence opt2 from hemagglutinin__InfluenzaA__ADM23851
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97159 - RNA, 1701 nt, Artificial Sequence
  derived and/or modified sequence opt2 from hemagglutinin__InfluenzaA__ADM23852
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97160 - RNA, 1701 nt, Artificial Sequence; identical to SEQ ID NO: 97159
  derived and/or modified sequence opt2 from hemagglutinin__InfluenzaA__ADM23853

SEQ ID NO: 97161 - RNA, 1701 nt, Artificial Sequence; identical to SEQ ID NO: 94423
  derived and/or modified sequence opt2 from hemagglutinin__InfluenzaA__ADM23855

SEQ ID NO: 97162 - RNA, 1701 nt, Artificial Sequence
  derived and/or modified sequence opt2 from hemagglutinin__InfluenzaA__ADM23856
augaaggccauccucgucguccuccucuacaccuucgccaccgucaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccaguccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97163 - RNA, 1701 nt, Artificial Sequence; identical to SEQ ID NO: 94181
  derived and/or modified sequence opt2 from hemagglutinin__InfluenzaA__ADM25945

SEQ ID NO: 97164 - RNA, 1701 nt, Artificial Sequence; identical to SEQ ID NO: 94423
  derived and/or modified sequence opt2 from hemagglutinin__InfluenzaA__ADM25948

SEQ ID NO: 97165 - RNA, 1701 nt, Artificial Sequence; identical to SEQ ID NO: 96210
  derived and/or modified sequence opt2 from hemagglutinin__InfluenzaA__ADM26264

SEQ ID NO: 97166 - RNA, 1701 nt, Artificial Sequence; identical to SEQ ID NO: 96210
  derived and/or modified sequence opt2 from hemagglutinin__InfluenzaA__ADM26265

SEQ ID NO: 97167 - RNA, 1701 nt, Artificial Sequence; identical to SEQ ID NO: 96210
  derived and/or modified sequence opt2 from hemagglutinin__InfluenzaA__ADM26266

SEQ ID NO: 97168 - RNA, 1701 nt, Artificial Sequence; identical to SEQ ID NO: 96210
  derived and/or modified sequence opt2 from hemagglutinin__InfluenzaA__ADM26267

SEQ ID NO: 97169 - RNA, 1701 nt, Artificial Sequence
  derived and/or modified sequence opt2 from hemagglutinin__InfluenzaA__ADM26268
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaagcgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97170 - RNA, 1701 nt, Artificial Sequence
  derived and/or modified sequence opt2 from hemagglutinin__InfluenzaA__ADM26269
augaagaccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaagcgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97171 - RNA, 1701 nt, Artificial Sequence
  derived and/or modified sequence opt2 from hemagglutinin__InfluenzaA__ADM26270
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgaccaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97172 - RNA, 1701 nt, Artificial Sequence; identical to SEQ ID NO: 96210
  derived and/or modified sequence opt2 from hemagglutinin__InfluenzaA__ADM26271

SEQ ID NO: 97173 - RNA, 1701 nt, Artificial Sequence
  derived and/or modified sequence opt2 from hemagglutinin__InfluenzaA__ADM26272
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97174 - RNA, 1701 nt, Artificial Sequence
  derived and/or modified sequence opt2 from hemagglutinin__InfluenzaA__ADM26274
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaaggaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97175 - RNA, 1701 nt, Artificial Sequence; identical to SEQ ID NO: 96210
  derived and/or modified sequence opt2 from hemagglutinin__InfluenzaA__ADM26276

SEQ ID NO: 97176 - RNA, 1701 nt, Artificial Sequence
  derived and/or modified sequence opt2 from hemagglutinin__InfluenzaA__ADM26277
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 97177 - RNA, 1701 nt, Artificial Sequence
  derived and/or modified sequence opt2 from hemagglutinin__InfluenzaA__ADM26278
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuccgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuucgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaagcgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97178 - RNA, 1701 nt, Artificial Sequence
  derived and/or modified sequence opt2 from hemagglutinin__InfluenzaA__ADM26279
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97179 - RNA, 1701 nt, Artificial Sequence; identical to SEQ ID NO: 96210
  derived and/or modified sequence opt2 from hemagglutinin__InfluenzaA__ADM26280

SEQ ID NO: 97180 - RNA, 1701 nt, Artificial Sequence
  derived and/or modified sequence opt2 from hemagglutinin__InfluenzaA__ADM26281
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccaguccauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 97181 - RNA, 1701 nt, Artificial Sequence
  derived and/or modified sequence opt2 from hemagglutinin__InfluenzaA__ADM26282
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97182 - RNA, 1701 nt, Artificial Sequence
  derived and/or modified sequence opt2 from hemagglutinin__InfluenzaA__ADM26283
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97183 - RNA, 1701 nt, Artificial Sequence; identical to SEQ ID NO: 96210
  derived and/or modified sequence opt2 from hemagglutinin__InfluenzaA__ADM26284

SEQ ID NO: 97184 - RNA, 1701 nt, Artificial Sequence; identical to SEQ ID NO: 96210
  derived and/or modified sequence opt2 from hemagglutinin__InfluenzaA__ADM26285

SEQ ID NO: 97185 - RNA, 1701 nt, Artificial Sequence
  derived and/or modified sequence opt2 from hemagglutinin__InfluenzaA__ADM26784
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97186 - RNA, 1701 nt, Artificial Sequence; identical to SEQ ID NO: 93946
  derived and/or modified sequence opt2 from hemagglutinin__InfluenzaA__ADM26795

SEQ ID NO: 97187 - RNA, 1701 nt, Artificial Sequence
  derived and/or modified sequence opt2 from hemagglutinin__InfluenzaA__ADM26817
augaagaccaccaucgcccucucccacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgccgccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97188 - RNA, 1704 nt, Artificial Sequence
  derived and/or modified sequence opt2 from hemagglutinin__InfluenzaA__ADM31424
auggagaagaucguccuccucuucaccaccaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaacccccucugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccugguccgaccacgaggccucccucggcgucuccgccgccugcuccuaccagggcaacuccuccuucuuccgcaacgucgucuggcucaucaagaaggacaacgccuaccccaccaucaagaaggacuacaacaacaccaaccaggaggaccuccucguccucuggggcauccaccaccccaacgacgaggccgagcagacccgccucuaccagaaccccaccaccuacaucuccaucggcaccuccacccucaaccagcgccucguccccaagaucgccacccgcuccaagaucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugaaguccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcucaaggacaacgccaaggagcucggcaacggcugcuucgaguucuaccacaagugcaacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 97189 - RNA, 1701 nt, Artificial Sequence; identical to SEQ ID NO: 96782
  derived and/or modified sequence opt2 from hemagglutinin__InfluenzaA__ADM31478

SEQ ID NO: 97190 - RNA, 1701 nt, Artificial Sequence
  derived and/or modified sequence opt2 from hemagglutinin__InfluenzaA__ADM31488
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97191 - RNA, 1701 nt, Artificial Sequence
  derived and/or modified sequence opt2 from hemagglutinin__InfluenzaA__ADM31498
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97192 - RNA, 1701 nt, Artificial Sequence
  derived and/or modified sequence opt2 from hemagglutinin__InfluenzaA__ADM31508
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagacccgcuccuggcccaaccacgacuccaacaagggcgucaccgccgccugcccccacgccggcgccaaguccuucuacaagucccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97193 - RNA, 1701 nt, Artificial Sequence
  derived and/or modified sequence opt2 from hemagglutinin__InfluenzaA__ADM31518
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacgucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97194 - RNA, 1701 nt, Artificial Sequence
  derived and/or modified sequence opt2 from hemagglutinin__InfluenzaA__ADM31528
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97195 - RNA, 1701 nt, Artificial Sequence
  derived and/or modified sequence opt2 from hemagglutinin__InfluenzaA__ADM31538
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97196 - RNA, 1701 nt, Artificial Sequence
  derived and/or modified sequence opt2 from hemagglutinin__InfluenzaA__ADM31548
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgaggucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97197 - RNA, 1701 nt, Artificial Sequence
  derived and/or modified sequence opt2 from hemagglutinin__InfluenzaA__ADM31558
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagauccgcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97198 - RNA, 1701 nt, Artificial Sequence; identical to SEQ ID NO: 95778
  derived and/or modified sequence opt2 from hemagglutinin__InfluenzaA__ADM31568

SEQ ID NO: 97199 - RNA, 1701 nt, Artificial Sequence; identical to SEQ ID NO: 94181
  derived and/or modified sequence opt2 from hemagglutinin__InfluenzaA__ADM31578

SEQ ID NO: 97200 - RNA, 1701 nt, Artificial Sequence
  derived and/or modified sequence opt2 from hemagglutinin__InfluenzaA__ADM31588
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagaccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97201 - RNA, 1701 nt, Artificial Sequence
  derived and/or modified sequence opt2 from hemagglutinin__InfluenzaA__ADM31598
augaacgccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97202 - RNA, 1701 nt, Artificial Sequence
  derived and/or modified sequence opt2 from hemagglutinin__InfluenzaA__ADM31608
augaaggccauccucgucguccuccucuacaccuucgccaccgucaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97203 - RNA, 1701 nt, Artificial Sequence; identical to SEQ ID NO: 95733
  derived and/or modified sequence opt2 from hemagglutinin__InfluenzaA__ADM31618

SEQ ID NO: 97204 - RNA, 1701 nt, Artificial Sequence; identical to SEQ ID NO: 95345
  derived and/or modified sequence opt2 from hemagglutinin__InfluenzaA__ADM31628

SEQ ID NO: 97205 - RNA, 1701 nt, Artificial Sequence; identical to SEQ ID NO: 97084
  derived and/or modified sequence opt2 from hemagglutinin__InfluenzaA__ADM31638

SEQ ID NO: 97206 - RNA, 1701 nt, Artificial Sequence; identical to SEQ ID NO: 95601
  derived and/or modified sequence opt2 from hemagglutinin__InfluenzaA__ADM31648

SEQ ID NO: 97207 - RNA, 1701 nt, Artificial Sequence; identical to SEQ ID NO: 96348
  derived and/or modified sequence opt2 from hemagglutinin__InfluenzaA__ADM31658

SEQ ID NO: 97208 - RNA, 1701 nt, Artificial Sequence; identical to SEQ ID NO: 95601
  derived and/or modified sequence opt2 from hemagglutinin__InfluenzaA__ADM31668

SEQ ID NO: 97209 - RNA, 1701 nt, Artificial Sequence; identical to SEQ ID NO: 94181
  derived and/or modified sequence opt2 from hemagglutinin__InfluenzaA__ADM31688

SEQ ID NO: 97210 - RNA, 1701 nt, Artificial Sequence
  derived and/or modified sequence opt2 from hemagglutinin__InfluenzaA__ADM31698
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 97211 - RNA, 1701 nt, Artificial Sequence; identical to SEQ ID NO: 97086
  derived and/or modified sequence opt2 from hemagglutinin__InfluenzaA__ADM31708

SEQ ID NO: 97212 - RNA, 1701 nt, Artificial Sequence
  derived and/or modified sequence opt2 from hemagglutinin__InfluenzaA__ADM31718
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97213 - RNA, 1701 nt, Artificial Sequence
  derived and/or modified sequence opt2 from hemagglutinin__InfluenzaA__ADM31728
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaccuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97214 - RNA, 1701 nt, Artificial Sequence
  derived and/or modified sequence opt2 from hemagglutinin__InfluenzaA__ADM31738
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgcccgcuccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97215 - RNA, 1701 nt, Artificial Sequence; identical to SEQ ID NO: 95830
  derived and/or modified sequence opt2 from hemagglutinin__InfluenzaA__ADM31748

SEQ ID NO: 97216 - RNA, 1701 nt, Artificial Sequence
  derived and/or modified sequence opt2 from hemagglutinin__InfluenzaA__ADM31758
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgaccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97217 - RNA, 1701 nt, Artificial Sequence; identical to SEQ ID NO: 94541
  derived and/or modified sequence opt2 from hemagglutinin__InfluenzaA__ADM31768

SEQ ID NO: 97218 - RNA, 1701 nt, Artificial Sequence; identical to SEQ ID NO: 94181
  derived and/or modified sequence opt2 from hemagglutinin__InfluenzaA__ADM31778

SEQ ID NO: 97219 - RNA, 1701 nt, Artificial Sequence; identical to SEQ ID NO: 96348
  derived and/or modified sequence opt2 from hemagglutinin__InfluenzaA__ADM31798

SEQ ID NO: 97220 - RNA, 1701 nt, Artificial Sequence
  derived and/or modified sequence opt2 from hemagglutinin__InfluenzaA__ADM31808
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccuccucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucggccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97221 - RNA, 1701 nt, Artificial Sequence; identical to SEQ ID NO: 96348
  derived and/or modified sequence opt2 from hemagglutinin__InfluenzaA__ADM31818

SEQ ID NO: 97222 - RNA, 1701 nt, Artificial Sequence
  derived and/or modified sequence opt2 from hemagglutinin__InfluenzaA__ADM31828
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaaguccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 97223 - RNA, 1701 nt, Artificial Sequence; identical to SEQ ID NO: 97222
  derived and/or modified sequence opt2 from hemagglutinin__InfluenzaA__ADM31838

SEQ ID NO: 97224 - RNA, 1701 nt, Artificial Sequence; identical to SEQ ID NO: 94181
  derived and/or modified sequence opt2 from hemagglutinin__InfluenzaA__ADM31848

SEQ ID NO: 97225 - RNA, 1701 nt, Artificial Sequence
  derived and/or modified sequence opt2 from hemagglutinin__InfluenzaA__ADM31858
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucgagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97226 - RNA, 1701 nt, Artificial Sequence
  derived and/or modified sequence opt2 from hemagglutinin__InfluenzaA__ADM31868
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcguccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucuccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97227 - RNA, 1701 nt, Artificial Sequence
  derived and/or modified sequence opt2 from hemagglutinin__InfluenzaA__ADM31878
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97228 - RNA, 1701 nt, Artificial Sequence; identical to SEQ ID NO: 95830
  derived and/or modified sequence opt2 from hemagglutinin__InfluenzaA__ADM31888

SEQ ID NO: 97229 - RNA, 1701 nt, Artificial Sequence; identical to SEQ ID NO: 94361
  derived and/or modified sequence opt2 from hemagglutinin__InfluenzaA__ADM31898

SEQ ID NO: 97230 - RNA, 1701 nt, Artificial Sequence
  derived and/or modified sequence opt2 from hemagglutinin__InfluenzaA__ADM31908
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgaccacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97231 - RNA, 1701 nt, Artificial Sequence; identical to SEQ ID NO: 94361
  derived and/or modified sequence opt2 from hemagglutinin__InfluenzaA__ADM31918

SEQ ID NO: 97232 - RNA, 1701 nt, Artificial Sequence; identical to SEQ ID NO: 95953
  derived and/or modified sequence opt2 from hemagglutinin__InfluenzaA__ADM31928

SEQ ID NO: 97233 - RNA, 1701 nt, Artificial Sequence; identical to SEQ ID NO: 95953
  derived and/or modified sequence opt2 from hemagglutinin__InfluenzaA__ADM31948

SEQ ID NO: 97234 - RNA, 1701 nt, Artificial Sequence; identical to SEQ ID NO: 94181
  derived and/or modified sequence opt2 from hemagglutinin__InfluenzaA__ADM31958

SEQ ID NO: 97235 - RNA, 1701 nt, Artificial Sequence; identical to SEQ ID NO: 95953
  derived and/or modified sequence opt2 from hemagglutinin__InfluenzaA__ADM31968

SEQ ID NO: 97236 - RNA, 1701 nt, Artificial Sequence; identical to SEQ ID NO: 95769
  derived and/or modified sequence opt2 from hemagglutinin__InfluenzaA__ADM31978

SEQ ID NO: 97237 - RNA, 1701 nt, Artificial Sequence; identical to SEQ ID NO: 94361
  derived and/or modified sequence opt2 from hemagglutinin__InfluenzaA__ADM31998

SEQ ID NO: 97238 - RNA, 1701 nt, Artificial Sequence; identical to SEQ ID NO: 94361
  derived and/or modified sequence opt2 from hemagglutinin__InfluenzaA__ADM32008

SEQ ID NO: 97239 - RNA, 1701 nt, Artificial Sequence
  derived and/or modified sequence opt2 from hemagglutinin__InfluenzaA__ADM32018
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97240 - RNA, 1701 nt, Artificial Sequence
  derived and/or modified sequence opt2 from hemagglutinin__InfluenzaA__ADM32028
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97241 - RNA, 1701 nt, Artificial Sequence; identical to SEQ ID NO: 95953
  derived and/or modified sequence opt2 from hemagglutinin__InfluenzaA__ADM32038

SEQ ID NO: 97242 - RNA, 1701 nt, Artificial Sequence; identical to SEQ ID NO: 94361
  derived and/or modified sequence opt2 from hemagglutinin__InfluenzaA__ADM32048

SEQ ID NO: 97243 - RNA, 1701 nt, Artificial Sequence; identical to SEQ ID NO: 95345
  derived and/or modified sequence opt2 from hemagglutinin__InfluenzaA__ADM32058

SEQ ID NO: 97244 - RNA, 1701 nt, Artificial Sequence; identical to SEQ ID NO: 95345
  derived and/or modified sequence opt2 from hemagglutinin__InfluenzaA__ADM32068

SEQ ID NO: 97245 - RNA, 1701 nt, Artificial Sequence; identical to SEQ ID NO: 94181
  derived and/or modified sequence opt2 from hemagglutinin__InfluenzaA__ADM32078

SEQ ID NO: 97246 - RNA, 1701 nt, Artificial Sequence; identical to SEQ ID NO: 95769
  derived and/or modified sequence opt2 from hemagglutinin__InfluenzaA__ADM32088

SEQ ID NO: 97247 - RNA, 1701 nt, Artificial Sequence
  derived and/or modified sequence opt2 from hemagglutinin__InfluenzaA__ADM32098
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97248 - RNA, 1701 nt, Artificial Sequence; identical to SEQ ID NO: 94181
  derived and/or modified sequence opt2 from hemagglutinin__InfluenzaA__ADM32108

SEQ ID NO: 97249 - RNA, 1701 nt, Artificial Sequence; identical to SEQ ID NO: 95953
  derived and/or modified sequence opt2 from hemagglutinin__InfluenzaA__ADM32551

SEQ ID NO: 97250 - RNA, 1701 nt, Artificial Sequence; identical to SEQ ID NO: 94361
  derived and/or modified sequence opt2 from hemagglutinin__InfluenzaA__ADM32561

SEQ ID NO: 97251 - RNA, 1701 nt, Artificial Sequence; identical to SEQ ID NO: 94361
  derived and/or modified sequence opt2 from hemagglutinin__InfluenzaA__ADM32571

SEQ ID NO: 97252 - RNA, 1701 nt, Artificial Sequence; identical to SEQ ID NO: 94181
  derived and/or modified sequence opt2 from hemagglutinin__InfluenzaA__ADM32581

SEQ ID NO: 97253 - RNA, 1701 nt, Artificial Sequence; identical to SEQ ID NO: 95953
  derived and/or modified sequence opt2 from hemagglutinin__InfluenzaA__ADM32591

SEQ ID NO: 97254 - RNA, 1701 nt, Artificial Sequence; identical to SEQ ID NO: 94181
  derived and/or modified sequence opt2 from hemagglutinin__InfluenzaA__ADM32601

SEQ ID NO: 97255 - RNA, 1701 nt, Artificial Sequence; identical to SEQ ID NO: 94181
  derived and/or modified sequence opt2 from hemagglutinin__InfluenzaA__ADM32611

SEQ ID NO: 97256 - RNA, 1701 nt, Artificial Sequence; identical to SEQ ID NO: 95345
  derived and/or modified sequence opt2 from hemagglutinin__InfluenzaA__ADM32621

SEQ ID NO: 97257 - RNA, 1701 nt, Artificial Sequence
  derived and/or modified sequence opt2 from hemagglutinin__InfluenzaA__ADM32631
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaaccucuaccccaagcucuccaaguccuacaucaacgacaagggcaaggagguccucguccucuggggcauccaccaccccuccaccuccgccgaccagcagucccucuaccagaacgccgacgccuacgucuucgucggcuccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97258 - RNA, 1701 nt, Artificial Sequence; identical to SEQ ID NO: 95345
  derived and/or modified sequence opt2 from hemagglutinin__InfluenzaA__ADM32641

SEQ ID NO: 97259 - RNA, 1701 nt, Artificial Sequence; identical to SEQ ID NO: 94181
  derived and/or modified sequence opt2 from hemagglutinin__InfluenzaA__ADM32651

SEQ ID NO: 97260 - RNA, 1701 nt, Artificial Sequence
  derived and/or modified sequence opt2 from hemagglutinin__InfluenzaA__ADM32661
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaacgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97261 - RNA, 1701 nt, Artificial Sequence; identical to SEQ ID NO: 95769
  derived and/or modified sequence opt2 from hemagglutinin__InfluenzaA__ADM32671

SEQ ID NO: 97262 - RNA, 1701 nt, Artificial Sequence; identical to SEQ ID NO: 94181
  derived and/or modified sequence opt2 from hemagglutinin__InfluenzaA__ADM32681

SEQ ID NO: 97263 - RNA, 1701 nt, Artificial Sequence; identical to SEQ ID NO: 94361
  derived and/or modified sequence opt2 from hemagglutinin__InfluenzaA__ADM32691

SEQ ID NO: 97264 - RNA, 1701 nt, Artificial Sequence; identical to SEQ ID NO: 94181
  derived and/or modified sequence opt2 from hemagglutinin__InfluenzaA__ADM32701

SEQ ID NO: 97265 - RNA, 1701 nt, Artificial Sequence; identical to SEQ ID NO: 94361
  derived and/or modified sequence opt2 from hemagglutinin__InfluenzaA__ADM32711

SEQ ID NO: 97266 - RNA, 1701 nt, Artificial Sequence; identical to SEQ ID NO: 94361
  derived and/or modified sequence opt2 from hemagglutinin__InfluenzaA__ADM32721

SEQ ID NO: 97267 - RNA, 1701 nt, Artificial Sequence; identical to SEQ ID NO: 94361
  derived and/or modified sequence opt2 from hemagglutinin__InfluenzaA__ADM32741

SEQ ID NO: 97268 - RNA, 1701 nt, Artificial Sequence; identical to SEQ ID NO: 94361
  derived and/or modified sequence opt2 from hemagglutinin__InfluenzaA__ADM32751

SEQ ID NO: 97269 - RNA, 1701 nt, Artificial Sequence; identical to SEQ ID NO: 95769
  derived and/or modified sequence opt2 from hemagglutinin__InfluenzaA__ADM32761

SEQ ID NO: 97270 - RNA, 1701 nt, Artificial Sequence
  derived and/or modified sequence opt2 from hemagglutinin__InfluenzaA__ADM32771
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccaguccaagggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97271 - RNA, 1701 nt, Artificial Sequence
  derived and/or modified sequence opt2 from hemagglutinin__InfluenzaA__ADM32781
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccuccuuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97272 - RNA, 1701 nt, Artificial Sequence; identical to SEQ ID NO: 94361
  derived and/or modified sequence opt2 from hemagglutinin__InfluenzaA__ADM32791

SEQ ID NO: 97273 - RNA, 1701 nt, Artificial Sequence
  derived and/or modified sequence opt2 from hemagglutinin__InfluenzaA__ADM32801
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgagaacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97274 - RNA, 1701 nt, Artificial Sequence
  derived and/or modified sequence opt2 from hemagglutinin__InfluenzaA__ADM32811
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97275 - RNA, 1701 nt, Artificial Sequence; identical to SEQ ID NO: 94181
  derived and/or modified sequence opt2 from hemagglutinin__InfluenzaA__ADM32821

SEQ ID NO: 97276 - RNA, 1701 nt, Artificial Sequence; identical to SEQ ID NO: 95769
  derived and/or modified sequence opt2 from hemagglutinin__InfluenzaA__ADM32831

SEQ ID NO: 97277 - RNA, 1701 nt, Artificial Sequence; identical to SEQ ID NO: 94361
  derived and/or modified sequence opt2 from hemagglutinin__InfluenzaA__ADM32841

SEQ ID NO: 97278 - RNA, 1701 nt, Artificial Sequence; identical to SEQ ID NO: 95769
  derived and/or modified sequence opt2 from hemagglutinin__InfluenzaA__ADM32851

SEQ ID NO: 97279 - RNA, 1701 nt, Artificial Sequence; identical to SEQ ID NO: 94361
  derived and/or modified sequence opt2 from hemagglutinin__InfluenzaA__ADM32861

SEQ ID NO: 97280 - RNA, 1701 nt, Artificial Sequence; identical to SEQ ID NO: 95345
  derived and/or modified sequence opt2 from hemagglutinin__InfluenzaA__ADM32871

SEQ ID NO: 97281 - RNA, 1701 nt, Artificial Sequence; identical to SEQ ID NO: 96348
  derived and/or modified sequence opt2 from hemagglutinin__InfluenzaA__ADM32881

SEQ ID NO: 97282 - RNA, 1701 nt, Artificial Sequence
  derived and/or modified sequence opt2 from hemagglutinin__InfluenzaA__ADM32929
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97283 - RNA, 1701 nt, Artificial Sequence
  derived and/or modified sequence opt2 from hemagglutinin__InfluenzaA__ADM32939
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97284 - RNA, 1701 nt, Artificial Sequence
  derived and/or modified sequence opt2 from hemagglutinin__InfluenzaA__ADM32949
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97285 - RNA, 1701 nt, Artificial Sequence
  derived and/or modified sequence opt2 from hemagglutinin__InfluenzaA__ADM32958
augaaggccauccucgucuuccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucgaguccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgccucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccgcugccgcaucugcaucuga

SEQ ID NO: 97286 - RNA, 1701 nt, Artificial Sequence
  derived and/or modified sequence opt2 from hemagglutinin__InfluenzaA__ADM32977
augaaggccauccucgucguccuccucugcaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97287 - RNA, 1701 nt, Artificial Sequence
  derived and/or modified sequence opt2 from hemagglutinin__InfluenzaA__ADM32986
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucaacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97288 - RNA, 1701 nt, Artificial Sequence
  derived and/or modified sequence opt2 from hemagglutinin__InfluenzaA__ADM32995
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97289 - RNA, 1701 nt, Artificial Sequence; identical to SEQ ID NO: 95282
  derived and/or modified sequence opt2 from hemagglutinin__InfluenzaA__ADM33004

SEQ ID NO: 97290 - RNA, 1701 nt, Artificial Sequence; identical to SEQ ID NO: 94181
  derived and/or modified sequence opt2 from hemagglutinin__InfluenzaA__ADM33023

SEQ ID NO: 97291 - RNA, 1701 nt, Artificial Sequence
  derived and/or modified sequence opt2 from hemagglutinin__InfluenzaA__ADM33040
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97292 - RNA, 1701 nt, Artificial Sequence
  derived and/or modified sequence opt2 from hemagglutinin__InfluenzaA__ADM33050
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97293 - RNA, 1701 nt, Artificial Sequence
  derived and/or modified sequence opt2 from hemagglutinin__InfluenzaA__ADM33069
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97294 - RNA, 1701 nt, Artificial Sequence
  derived and/or modified sequence opt2 from hemagglutinin__InfluenzaA__ADM33079
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97295 - RNA, 1701 nt, Artificial Sequence
  derived and/or modified sequence opt2 from hemagglutinin__InfluenzaA__ADM33099
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97296 - RNA, 1701 nt, Artificial Sequence; identical to SEQ ID NO: 97295
  derived and/or modified sequence opt2 from hemagglutinin__InfluenzaA__ADM33109

SEQ ID NO: 97297 - RNA, 1701 nt, Artificial Sequence
  derived and/or modified sequence opt2 from hemagglutinin__InfluenzaA__ADM33128
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97298 - RNA, 1701 nt, Artificial Sequence; identical to SEQ ID NO: 97297
  derived and/or modified sequence opt2 from hemagglutinin__InfluenzaA__ADM33137

SEQ ID NO: 97299 - RNA, 1701 nt, Artificial Sequence; identical to SEQ ID NO: 97297
  derived and/or modified sequence opt2 from hemagglutinin__InfluenzaA__ADM33147

SEQ ID NO: 97300 - RNA, 1701 nt, Artificial Sequence; identical to SEQ ID NO: 97297
  derived and/or modified sequence opt2 from hemagglutinin__InfluenzaA__ADM33157

SEQ ID NO: 97301 - RNA, 1701 nt, Artificial Sequence
  derived and/or modified sequence opt2 from hemagglutinin__InfluenzaA__ADM33167
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97302 - RNA, 1701 nt, Artificial Sequence; identical to SEQ ID NO: 96368
  derived and/or modified sequence opt2 from hemagglutinin__InfluenzaA__ADM33177

SEQ ID NO: 97303 - RNA, 1701 nt, Artificial Sequence; identical to SEQ ID NO: 97297
  derived and/or modified sequence opt2 from hemagglutinin__InfluenzaA__ADM33186

SEQ ID NO: 97304 - RNA, 1701 nt, Artificial Sequence; identical to SEQ ID NO: 97297
  derived and/or modified sequence opt2 from hemagglutinin__InfluenzaA__ADM33195

SEQ ID NO: 97305 - RNA, 1701 nt, Artificial Sequence; identical to SEQ ID NO: 97294
  derived and/or modified sequence opt2 from hemagglutinin__InfluenzaA__ADM33204

SEQ ID NO: 97306 - RNA, 1701 nt, Artificial Sequence
  derived and/or modified sequence opt2 from hemagglutinin__InfluenzaA__ADM33222
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97307 - RNA, 1701 nt, Artificial Sequence
  derived and/or modified sequence opt2 from hemagglutinin__InfluenzaA__ADM33232
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaccaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97308 - RNA, 1701 nt, Artificial Sequence
  derived and/or modified sequence opt2 from hemagglutinin__InfluenzaA__ADM33241
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucaccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97309 - RNA, 1701 nt, Artificial Sequence; identical to SEQ ID NO: 97306
  derived and/or modified sequence opt2 from hemagglutinin__InfluenzaA__ADM33251

SEQ ID NO: 97310 - RNA, 1701 nt, Artificial Sequence
  derived and/or modified sequence opt2 from hemagglutinin__InfluenzaA__ADM33260
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcgacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacaccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccgcugccgcaucugcaucuga

SEQ ID NO: 97311 - RNA, 1701 nt, Artificial Sequence
  derived and/or modified sequence opt2 from hemagglutinin__InfluenzaA__ADM33280
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgucuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccccccgcggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97312 - RNA, 1701 nt, Artificial Sequence; identical to SEQ ID NO: 94628
  derived and/or modified sequence opt2 from hemagglutinin__InfluenzaA__ADM33290

SEQ ID NO: 97313 - RNA, 1701 nt, Artificial Sequence; identical to SEQ ID NO: 94181
  derived and/or modified sequence opt2 from hemagglutinin__InfluenzaA__ADM33300

SEQ ID NO: 97314 - RNA, 1701 nt, Artificial Sequence; identical to SEQ ID NO: 94168
  derived and/or modified sequence opt2 from hemagglutinin__InfluenzaA__ADM33310

SEQ ID NO: 97315 - RNA, 1701 nt, Artificial Sequence
  derived and/or modified sequence opt2 from hemagglutinin__InfluenzaA__ADM33320
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuucuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97316 - RNA, 1701 nt, Artificial Sequence; identical to SEQ ID NO: 94207
  derived and/or modified sequence opt2 from hemagglutinin__InfluenzaA__ADM33340

SEQ ID NO: 97317 - RNA, 1701 nt, Artificial Sequence
  derived and/or modified sequence opt2 from hemagglutinin__InfluenzaA__ADM33355
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97318 - RNA, 1701 nt, Artificial Sequence; identical to SEQ ID NO: 97317
  derived and/or modified sequence opt2 from hemagglutinin__InfluenzaA__ADM33365

SEQ ID NO: 97319 - RNA, 1701 nt, Artificial Sequence; identical to SEQ ID NO: 94207
  derived and/or modified sequence opt2 from hemagglutinin__InfluenzaA__ADM33375

SEQ ID NO: 97320 - RNA, 1701 nt, Artificial Sequence
  derived and/or modified sequence opt2 from hemagglutinin__InfluenzaA__ADM33385
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97321 - RNA, 1701 nt, Artificial Sequence; identical to SEQ ID NO: 94628
  derived and/or modified sequence opt2 from hemagglutinin__InfluenzaA__ADM33395

SEQ ID NO: 97322 - RNA, 1701 nt, Artificial Sequence; identical to SEQ ID NO: 94628
  derived and/or modified sequence opt2 from hemagglutinin__InfluenzaA__ADM33405

SEQ ID NO: 97323 - RNA, 1701 nt, Artificial Sequence; identical to SEQ ID NO: 97317
  derived and/or modified sequence opt2 from hemagglutinin__InfluenzaA__ADM33415

SEQ ID NO: 97324 - RNA, 1701 nt, Artificial Sequence; identical to SEQ ID NO: 95024
  derived and/or modified sequence opt2 from hemagglutinin__InfluenzaA__ADM33425

SEQ ID NO: 97325 - RNA, 1701 nt, Artificial Sequence
  derived and/or modified sequence opt2 from hemagglutinin__InfluenzaA__ADM34007
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgaggagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97326 - RNA, 1701 nt, Artificial Sequence; identical to SEQ ID NO: 94181
  derived and/or modified sequence opt2 from hemagglutinin__InfluenzaA__ADM52443

SEQ ID NO: 97327 - RNA, 1701 nt, Artificial Sequence
  derived and/or modified sequence opt2 from hemagglutinin__InfluenzaA__ADM52453
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97328 - RNA, 1701 nt, Artificial Sequence
  derived and/or modified sequence opt2 from hemagglutinin__InfluenzaA__ADM52473
augaaggccauccucgccguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccuccucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucggccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97329 - RNA, 1701 nt, Artificial Sequence; identical to SEQ ID NO: 95345
  derived and/or modified sequence opt2 from hemagglutinin__InfluenzaA__ADM52483

SEQ ID NO: 97330 - RNA, 1701 nt, Artificial Sequence; identical to SEQ ID NO: 94361
  derived and/or modified sequence opt2 from hemagglutinin__InfluenzaA__ADM52493

SEQ ID NO: 97331 - RNA, 1701 nt, Artificial Sequence; identical to SEQ ID NO: 94361
  derived and/or modified sequence opt2 from hemagglutinin__InfluenzaA__ADM52513

SEQ ID NO: 97332 - RNA, 1701 nt, Artificial Sequence; identical to SEQ ID NO: 94361
  derived and/or modified sequence opt2 from hemagglutinin__InfluenzaA__ADM52524

SEQ ID NO: 97333 - RNA, 1701 nt, Artificial Sequence; identical to SEQ ID NO: 94361
  derived and/or modified sequence opt2 from hemagglutinin__InfluenzaA__ADM52534

SEQ ID NO: 97334 - RNA, 1701 nt, Artificial Sequence; identical to SEQ ID NO: 94361
  derived and/or modified sequence opt2 from hemagglutinin__InfluenzaA__ADM52554

SEQ ID NO: 97335 - RNA, 1701 nt, Artificial Sequence; identical to SEQ ID NO: 94361
  derived and/or modified sequence opt2 from hemagglutinin__InfluenzaA__ADM52564

SEQ ID NO: 97336 - RNA, 1701 nt, Artificial Sequence; identical to SEQ ID NO: 94168
  derived and/or modified sequence opt2 from hemagglutinin__InfluenzaA__ADM52574

SEQ ID NO: 97337 - RNA, 1701 nt, Artificial Sequence; identical to SEQ ID NO: 94181
  derived and/or modified sequence opt2 from hemagglutinin__InfluenzaA__ADM52584

SEQ ID NO: 97338 - RNA, 1701 nt, Artificial Sequence
  derived and/or modified sequence opt2 from hemagglutinin__InfluenzaA__ADM52594
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97339 - RNA, 1701 nt, Artificial Sequence; identical to SEQ ID NO: 94361
  derived and/or modified sequence opt2 from hemagglutinin__InfluenzaA__ADM52604

SEQ ID NO: 97340 - RNA, 1701 nt, Artificial Sequence; identical to SEQ ID NO: 94361
  derived and/or modified sequence opt2 from hemagglutinin__InfluenzaA__ADM52614

SEQ ID NO: 97341 - RNA, 1701 nt, Artificial Sequence; identical to SEQ ID NO: 95953
  derived and/or modified sequence opt2 from hemagglutinin__InfluenzaA__ADM52624

SEQ ID NO: 97342 - RNA, 1701 nt, Artificial Sequence; identical to SEQ ID NO: 94361
  derived and/or modified sequence opt2 from hemagglutinin__InfluenzaA__ADM52634

SEQ ID NO: 97343 - RNA, 1701 nt, Artificial Sequence; identical to SEQ ID NO: 94361
  derived and/or modified sequence opt2 from hemagglutinin__InfluenzaA__ADM52644

SEQ ID NO: 97344 - RNA, 1701 nt, Artificial Sequence; identical to SEQ ID NO: 94361
  derived and/or modified sequence opt2 from hemagglutinin__InfluenzaA__ADM52654

SEQ ID NO: 97345 - RNA, 1701 nt, Artificial Sequence; identical to SEQ ID NO: 95769
  derived and/or modified sequence opt2 from hemagglutinin__InfluenzaA__ADM52664

SEQ ID NO: 97346 - RNA, 1701 nt, Artificial Sequence; identical to SEQ ID NO: 95953
  derived and/or modified sequence opt2 from hemagglutinin__InfluenzaA__ADM52674

SEQ ID NO: 97347 - RNA, 1701 nt, Artificial Sequence; identical to SEQ ID NO: 94361
  derived and/or modified sequence opt2 from hemagglutinin__InfluenzaA__ADM52684

SEQ ID NO: 97348 - RNA, 1701 nt, Artificial Sequence; identical to SEQ ID NO: 95953
  derived and/or modified sequence opt2 from hemagglutinin__InfluenzaA__ADM52704

SEQ ID NO: 97349 - RNA, 1701 nt, Artificial Sequence; identical to SEQ ID NO: 95769
  derived and/or modified sequence opt2 from hemagglutinin__InfluenzaA__ADM52714

SEQ ID NO: 97350 - RNA, 1701 nt, Artificial Sequence
  derived and/or modified sequence opt2 from hemagglutinin__InfluenzaA__ADM86399
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97351 - RNA, 1701 nt, Artificial Sequence; identical to SEQ ID NO: 94181
  derived and/or modified sequence opt2 from hemagglutinin__InfluenzaA__ADM86409

SEQ ID NO: 97352 - RNA, 1701 nt, Artificial Sequence; identical to SEQ ID NO: 94181
  derived and/or modified sequence opt2 from hemagglutinin__InfluenzaA__ADM86419

SEQ ID NO: 97353 - RNA, 1701 nt, Artificial Sequence; identical to SEQ ID NO: 95830
  derived and/or modified sequence opt2 from hemagglutinin__InfluenzaA__ADM86440

SEQ ID NO: 97354 - RNA, 1701 nt, Artificial Sequence; identical to SEQ ID NO: 94181
  derived and/or modified sequence opt2 from hemagglutinin__InfluenzaA__ADM86450

SEQ ID NO: 97355 - RNA, 1707 nt, Artificial Sequence
  derived and/or modified sequence opt2 from hemagglutinin__InfluenzaA__ADM95450
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccuggcccucccacgaggccucccucggcgucuccgccgccugccccuaccagggcaaguccuccuucuuccgcaacgucgucuggcucaucaagaagaacaacaccuaccccaccaucaagcgcuccuacaacaacaccaaccaggaggaccuccucgucauguggggcauccaccaccccaacgacgccgccgagcagaccaaccucuaccagaaccccaccaccuacaucuccgucggcaccuccacccucaaccagcgccucaccccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagggccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 97356 - RNA, 1701 nt, Artificial Sequence; identical to SEQ ID NO: 94181
  derived and/or modified sequence opt2 from hemagglutinin__InfluenzaA__ADM95745

SEQ ID NO: 97357 - RNA, 1701 nt, Artificial Sequence; identical to SEQ ID NO: 94181
  derived and/or modified sequence opt2 from hemagglutinin__InfluenzaA__ADM95746

SEQ ID NO: 97358 - RNA, 1701 nt, Artificial Sequence; identical to SEQ ID NO: 94181
  derived and/or modified sequence opt2 from hemagglutinin__InfluenzaA__ADM95747

SEQ ID NO: 97359 - RNA, 1701 nt, Artificial Sequence; identical to SEQ ID NO: 94181
  derived and/or modified sequence opt2 from hemagglutinin__InfluenzaA__ADM95749

SEQ ID NO: 97360 - RNA, 1701 nt, Artificial Sequence
  derived and/or modified sequence opt2 from hemagglutinin__InfluenzaA__ADM95750
augaaggccauccucgucguccuccucuacaccuucgccaccgccaacgccgacacccucugcaucggcuaccacgccaacaacuccaccgacaccgucgacaccguccucgagaagaacgucaccgucacccacuccuucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcuccuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97361 - RNA, 1701 nt, Artificial Sequence; identical to SEQ ID NO: 94181
  derived and/or modified sequence opt2 from hemagglutinin__InfluenzaA__ADM95751

SEQ ID NO: 97362 - RNA, 1701 nt, Artificial Sequence; identical to SEQ ID NO: 94181
  derived and/or modified sequence opt2 from hemagglutinin__InfluenzaA__ADM95752

SEQ ID NO: 97363 - RNA, 1701 nt, Artificial Sequence; identical to SEQ ID NO: 94181
  derived and/or modified sequence opt2 from hemagglutinin__InfluenzaA__ADM95753

SEQ ID NO: 97364 - RNA, 1701 nt, Artificial Sequence; identical to SEQ ID NO: 94181
  derived and/or modified sequence opt2 from hemagglutinin__InfluenzaA__ADM95754

SEQ ID NO: 97365 - RNA, 1701 nt, Artificial Sequence; identical to SEQ ID NO: 94181
  derived and/or modified sequence opt2 from hemagglutinin__InfluenzaA__ADM95755

SEQ ID NO: 97366 - RNA, 1701 nt, Artificial Sequence; identical to SEQ ID NO: 94361
  derived and/or modified sequence opt2 from hemagglutinin__InfluenzaA__ADM95757

SEQ ID NO: 97367 - RNA, 1701 nt, Artificial Sequence; identical to SEQ ID NO: 94181
  derived and/or modified sequence opt2 from hemagglutinin__InfluenzaA__ADM95758

SEQ ID NO: 97368 - RNA, 1701 nt, Artificial Sequence
  derived and/or modified sequence opt2 from hemagglutinin__InfluenzaA__ADM95759
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacuacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97369 - RNA, 1701 nt, Artificial Sequence; identical to SEQ ID NO: 94168
  derived and/or modified sequence opt2 from hemagglutinin__InfluenzaA__ADM95760

SEQ ID NO: 97370 - RNA, 1701 nt, Artificial Sequence; identical to SEQ ID NO: 94181
  derived and/or modified sequence opt2 from hemagglutinin__InfluenzaA__ADM95761

SEQ ID NO: 97371 - RNA, 1701 nt, Artificial Sequence
  derived and/or modified sequence opt2 from hemagglutinin__InfluenzaA__ADM95763
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagaacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97372 - RNA, 1701 nt, Artificial Sequence; identical to SEQ ID NO: 94181
  derived and/or modified sequence opt2 from hemagglutinin__InfluenzaA__ADM95764

SEQ ID NO: 97373 - RNA, 1701 nt, Artificial Sequence; identical to SEQ ID NO: 94181
  derived and/or modified sequence opt2 from hemagglutinin__InfluenzaA__ADM95765

SEQ ID NO: 97374 - RNA, 1701 nt, Artificial Sequence; identical to SEQ ID NO: 94181
  derived and/or modified sequence opt2 from hemagglutinin__InfluenzaA__ADM95767

SEQ ID NO: 97375 - RNA, 1701 nt, Artificial Sequence; identical to SEQ ID NO: 95024
  derived and/or modified sequence opt2 from hemagglutinin__InfluenzaA__ADM95768

SEQ ID NO: 97376 - RNA, 1701 nt, Artificial Sequence; identical to SEQ ID NO: 94534
  derived and/or modified sequence opt2 from hemagglutinin__InfluenzaA__ADM95769

SEQ ID NO: 97377 - RNA, 1701 nt, Artificial Sequence; identical to SEQ ID NO: 96297
  derived and/or modified sequence opt2 from hemagglutinin__InfluenzaA__ADM95771

SEQ ID NO: 97378 - RNA, 1701 nt, Artificial Sequence; identical to SEQ ID NO: 94181
  derived and/or modified sequence opt2 from hemagglutinin__InfluenzaA__ADM95772

SEQ ID NO: 97379 - RNA, 1701 nt, Artificial Sequence; identical to SEQ ID NO: 94181
  derived and/or modified sequence opt2 from hemagglutinin__InfluenzaA__ADM95774

SEQ ID NO: 97380 - RNA, 1701 nt, Artificial Sequence; identical to SEQ ID NO: 94181
  derived and/or modified sequence opt2 from hemagglutinin__InfluenzaA__ADM95775

SEQ ID NO: 97381 - RNA, 1701 nt, Artificial Sequence; identical to SEQ ID NO: 94534
  derived and/or modified sequence opt2 from hemagglutinin__InfluenzaA__ADM95776

SEQ ID NO: 97382 - RNA, 1701 nt, Artificial Sequence; identical to SEQ ID NO: 94534
  derived and/or modified sequence opt2 from hemagglutinin__InfluenzaA__ADM95778

SEQ ID NO: 97383 - RNA, 1701 nt, Artificial Sequence
  derived and/or modified sequence opt2 from hemagglutinin__InfluenzaA__ADM95779
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgagcccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97384 - RNA, 1701 nt, Artificial Sequence; identical to SEQ ID NO: 94534
  derived and/or modified sequence opt2 from hemagglutinin__InfluenzaA__ADM95780

SEQ ID NO: 97385 - RNA, 1701 nt, Artificial Sequence; identical to SEQ ID NO: 95024
  derived and/or modified sequence opt2 from hemagglutinin__InfluenzaA__ADM95783

SEQ ID NO: 97386 - RNA, 1701 nt, Artificial Sequence; identical to SEQ ID NO: 94181
  derived and/or modified sequence opt2 from hemagglutinin__InfluenzaA__ADM95784

SEQ ID NO: 97387 - RNA, 1701 nt, Artificial Sequence; identical to SEQ ID NO: 94181
  derived and/or modified sequence opt2 from hemagglutinin__InfluenzaA__ADM95785

SEQ ID NO: 97388 - RNA, 1701 nt, Artificial Sequence
  derived and/or modified sequence opt2 from hemagglutinin__InfluenzaA__ADM95786
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97389 - RNA, 1701 nt, Artificial Sequence; identical to SEQ ID NO: 94534
  derived and/or modified sequence opt2 from hemagglutinin__InfluenzaA__ADM95788

SEQ ID NO: 97390 - RNA, 1701 nt, Artificial Sequence; identical to SEQ ID NO: 94534
  derived and/or modified sequence opt2 from hemagglutinin__InfluenzaA__ADM95789

SEQ ID NO: 97391 - RNA, 1701 nt, Artificial Sequence
  derived and/or modified sequence opt2 from hemagglutinin__InfluenzaA__ADM95790
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgcaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97392 - RNA, 1701 nt, Artificial Sequence; identical to SEQ ID NO: 97391
  derived and/or modified sequence opt2 from hemagglutinin__InfluenzaA__ADM95791

SEQ ID NO: 97393 - RNA, 1701 nt, Artificial Sequence; identical to SEQ ID NO: 97391
  derived and/or modified sequence opt2 from hemagglutinin__InfluenzaA__ADM95792

SEQ ID NO: 97394 - RNA, 1701 nt, Artificial Sequence; identical to SEQ ID NO: 96778
  derived and/or modified sequence opt2 from hemagglutinin__InfluenzaA__ADM95793

SEQ ID NO: 97395 - RNA, 1701 nt, Artificial Sequence; identical to SEQ ID NO: 94534
  derived and/or modified sequence opt2 from hemagglutinin__InfluenzaA__ADM95794

SEQ ID NO: 97396 - RNA, 1701 nt, Artificial Sequence; identical to SEQ ID NO: 94181
  derived and/or modified sequence opt2 from hemagglutinin__InfluenzaA__ADM95795

SEQ ID NO: 97397 - RNA, 1701 nt, Artificial Sequence; identical to SEQ ID NO: 95283
  derived and/or modified sequence opt2 from hemagglutinin__InfluenzaA__ADM95798

SEQ ID NO: 97398 - RNA, 1701 nt, Artificial Sequence
  derived and/or modified sequence opt2 from hemagglutinin__InfluenzaA__ADM95799
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucgagaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97399 - RNA, 1701 nt, Artificial Sequence
  derived and/or modified sequence opt2 from hemagglutinin__InfluenzaA__ADM95800
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgcccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97400 - RNA, 1701 nt, Artificial Sequence; identical to SEQ ID NO: 94534
  derived and/or modified sequence opt2 from hemagglutinin__InfluenzaA__ADM95801

SEQ ID NO: 97401 - RNA, 1701 nt, Artificial Sequence; identical to SEQ ID NO: 94534
  derived and/or modified sequence opt2 from hemagglutinin__InfluenzaA__ADM95802

SEQ ID NO: 97402 - RNA, 1701 nt, Artificial Sequence; identical to SEQ ID NO: 97388
  derived and/or modified sequence opt2 from hemagglutinin__InfluenzaA__ADM95803

SEQ ID NO: 97403 - RNA, 1701 nt, Artificial Sequence
  derived and/or modified sequence opt2 from hemagglutinin__InfluenzaA__ADM95804
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagaacuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97404 - RNA, 1701 nt, Artificial Sequence; identical to SEQ ID NO: 95863
  derived and/or modified sequence opt2 from hemagglutinin__InfluenzaA__ADM95805

SEQ ID NO: 97405 - RNA, 1701 nt, Artificial Sequence; identical to SEQ ID NO: 95282
  derived and/or modified sequence opt2 from hemagglutinin__InfluenzaA__ADM95808

SEQ ID NO: 97406 - RNA, 1701 nt, Artificial Sequence; identical to SEQ ID NO: 95282
  derived and/or modified sequence opt2 from hemagglutinin__InfluenzaA__ADM95809

SEQ ID NO: 97407 - RNA, 1701 nt, Artificial Sequence; identical to SEQ ID NO: 95282
  derived and/or modified sequence opt2 from hemagglutinin__InfluenzaA__ADM95810

SEQ ID NO: 97408 - RNA, 1701 nt, Artificial Sequence
  derived and/or modified sequence opt2 from hemagglutinin__InfluenzaA__ADM95812
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97409 - RNA, 1701 nt, Artificial Sequence; identical to SEQ ID NO: 96778
  derived and/or modified sequence opt2 from hemagglutinin__InfluenzaA__ADM95816

SEQ ID NO: 97410 - RNA, 1701 nt, Artificial Sequence; identical to SEQ ID NO: 96778
  derived and/or modified sequence opt2 from hemagglutinin__InfluenzaA__ADM95819

SEQ ID NO: 97411 - RNA, 1701 nt, Artificial Sequence; identical to SEQ ID NO: 95863
  derived and/or modified sequence opt2 from hemagglutinin__InfluenzaA__ADM95820

SEQ ID NO: 97412 - RNA, 1701 nt, Artificial Sequence; identical to SEQ ID NO: 96778
  derived and/or modified sequence opt2 from hemagglutinin__InfluenzaA__ADM95821

SEQ ID NO: 97413 - RNA, 1701 nt, Artificial Sequence; identical to SEQ ID NO: 95282
  derived and/or modified sequence opt2 from hemagglutinin__InfluenzaA__ADM95822

SEQ ID NO: 97414 - RNA, 1701 nt, Artificial Sequence; identical to SEQ ID NO: 95282
  derived and/or modified sequence opt2 from hemagglutinin__InfluenzaA__ADM95823

SEQ ID NO: 97415 - RNA, 1701 nt, Artificial Sequence
  derived and/or modified sequence opt2 from hemagglutinin__InfluenzaA__ADM95824
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97416 - RNA, 1701 nt, Artificial Sequence; identical to SEQ ID NO: 96778
  derived and/or modified sequence opt2 from hemagglutinin__InfluenzaA__ADM95825

SEQ ID NO: 97417 - RNA, 1701 nt, Artificial Sequence; identical to SEQ ID NO: 96778
  derived and/or modified sequence opt2 from hemagglutinin__InfluenzaA__ADM95826

SEQ ID NO: 97418 - RNA, 1701 nt, Artificial Sequence
  derived and/or modified sequence opt2 from hemagglutinin__InfluenzaA__ADM95827
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97419 - RNA, 1701 nt, Artificial Sequence
  derived and/or modified sequence opt2 from hemagglutinin__InfluenzaA__ADM95828
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97420 - RNA, 1701 nt, Artificial Sequence
  derived and/or modified sequence opt2 from hemagglutinin__InfluenzaA__ADM95829
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97421 - RNA, 1701 nt, Artificial Sequence
  derived and/or modified sequence opt2 from hemagglutinin__InfluenzaA__ADM95831
augaaggccauccucgucguccuccucuacaccuucgucaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97422 - RNA, 1701 nt, Artificial Sequence; identical to SEQ ID NO: 95282
  derived and/or modified sequence opt2 from hemagglutinin__InfluenzaA__ADM95832

SEQ ID NO: 97423 - RNA, 1701 nt, Artificial Sequence; identical to SEQ ID NO: 95863
  derived and/or modified sequence opt2 from hemagglutinin__InfluenzaA__ADM95833

SEQ ID NO: 97424 - RNA, 1701 nt, Artificial Sequence; identical to SEQ ID NO: 97408
  derived and/or modified sequence opt2 from hemagglutinin__InfluenzaA__ADM95834

SEQ ID NO: 97425 - RNA, 1701 nt, Artificial Sequence; identical to SEQ ID NO: 95863
  derived and/or modified sequence opt2 from hemagglutinin__InfluenzaA__ADM95836

SEQ ID NO: 97426 - RNA, 1701 nt, Artificial Sequence; identical to SEQ ID NO: 96778
  derived and/or modified sequence opt2 from hemagglutinin__InfluenzaA__ADM95837

SEQ ID NO: 97427 - RNA, 1701 nt, Artificial Sequence
  derived and/or modified sequence opt2 from hemagglutinin__InfluenzaA__ADM95838
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97428 - RNA, 1701 nt, Artificial Sequence; identical to SEQ ID NO: 95863
  derived and/or modified sequence opt2 from hemagglutinin__InfluenzaA__ADM95839

SEQ ID NO: 97429 - RNA, 1701 nt, Artificial Sequence; identical to SEQ ID NO: 97388
  derived and/or modified sequence opt2 from hemagglutinin__InfluenzaA__ADM95840

SEQ ID NO: 97430 - RNA, 1701 nt, Artificial Sequence; identical to SEQ ID NO: 97388
  derived and/or modified sequence opt2 from hemagglutinin__InfluenzaA__ADM95842

SEQ ID NO: 97431 - RNA, 1701 nt, Artificial Sequence; identical to SEQ ID NO: 96778
  derived and/or modified sequence opt2 from hemagglutinin__InfluenzaA__ADM95843

SEQ ID NO: 97432 - RNA, 1701 nt, Artificial Sequence; identical to SEQ ID NO: 96778
  derived and/or modified sequence opt2 from hemagglutinin__InfluenzaA__ADM95844

SEQ ID NO: 97433 - RNA, 1701 nt, Artificial Sequence
  derived and/or modified sequence opt2 from hemagglutinin__InfluenzaA__ADM95845
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggagaccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97434 - RNA, 1701 nt, Artificial Sequence
  derived and/or modified sequence opt2 from hemagglutinin__InfluenzaA__ADM95846
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgaggccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97435 - RNA, 1701 nt, Artificial Sequence; identical to SEQ ID NO: 95282
  derived and/or modified sequence opt2 from hemagglutinin__InfluenzaA__ADM95847

SEQ ID NO: 97436 - RNA, 1701 nt, Artificial Sequence; identical to SEQ ID NO: 95282
  derived and/or modified sequence opt2 from hemagglutinin__InfluenzaA__ADM95848

SEQ ID NO: 97437 - RNA, 1701 nt, Artificial Sequence
  derived and/or modified sequence opt2 from hemagglutinin__InfluenzaA__ADM95849
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucaucucccucggcgccaucuccuucuggaugugcuccaacggcucccuccagugccgcaucugcaucuga

SEQ ID NO: 97438 - RNA, 1701 nt, Artificial Sequence; identical to SEQ ID NO: 96778
  derived and/or modified sequence opt2 from hemagglutinin__InfluenzaA__ADM95850

SEQ ID NO: 97439 - RNA, 1701 nt, Artificial Sequence
  derived and/or modified sequence opt2 from hemagglutinin__InfluenzaA__ADM95851
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97440 - RNA, 1701 nt, Artificial Sequence
  derived and/or modified sequence opt2 from hemagglutinin__InfluenzaA__ADM95852
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagauccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97441 - RNA, 1701 nt, Artificial Sequence; identical to SEQ ID NO: 95601
  derived and/or modified sequence opt2 from hemagglutinin__InfluenzaA__ADM95854

SEQ ID NO: 97442 - RNA, 1701 nt, Artificial Sequence
  derived and/or modified sequence opt2 from hemagglutinin__InfluenzaA__ADM95855
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97443 - RNA, 1701 nt, Artificial Sequence
  derived and/or modified sequence opt2 from hemagglutinin__InfluenzaA__ADM95857
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97444 - RNA, 1701 nt, Artificial Sequence; identical to SEQ ID NO: 95863
  derived and/or modified sequence opt2 from hemagglutinin__InfluenzaA__ADM95858

SEQ ID NO: 97445 - RNA, 1701 nt, Artificial Sequence
  derived and/or modified sequence opt2 from hemagglutinin__InfluenzaA__ADM95859
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97446 - RNA, 1701 nt, Artificial Sequence; identical to SEQ ID NO: 95808
  derived and/or modified sequence opt2 from hemagglutinin__InfluenzaA__ADM95860

SEQ ID NO: 97447 - RNA, 1701 nt, Artificial Sequence; identical to SEQ ID NO: 97408
  derived and/or modified sequence opt2 from hemagglutinin__InfluenzaA__ADM95862

SEQ ID NO: 97448 - RNA, 1701 nt, Artificial Sequence
  derived and/or modified sequence opt2 from hemagglutinin__InfluenzaA__ADM95864
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgcccccgcguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97449 - RNA, 1701 nt, Artificial Sequence; identical to SEQ ID NO: 95733
  derived and/or modified sequence opt2 from hemagglutinin__InfluenzaA__ADM95865

SEQ ID NO: 97450 - RNA, 1701 nt, Artificial Sequence
  derived and/or modified sequence opt2 from hemagglutinin__InfluenzaA__ADM95866
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaucuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgucaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97451 - RNA, 1698 nt, Artificial Sequence; identical to SEQ ID NO: 97025
  derived and/or modified sequence opt2 from hemagglutinin__InfluenzaA__ADN06300

SEQ ID NO: 97452 - RNA, 1698 nt, Artificial Sequence
  derived and/or modified sequence opt2 from hemagglutinin__InfluenzaA__ADN06311
augaaggucaagcuccucguccuccucugcacccucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97453 - RNA, 1698 nt, Artificial Sequence
  derived and/or modified sequence opt2 from hemagglutinin__InfluenzaA__ADN06322
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacauggucgaccagcgcacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97454 - RNA, 1698 nt, Artificial Sequence
  derived and/or modified sequence opt2 from hemagglutinin__InfluenzaA__ADN06344
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97455 - RNA, 1701 nt, Artificial Sequence; identical to SEQ ID NO: 97045
  derived and/or modified sequence opt2 from hemagglutinin__InfluenzaA__ADN06366

SEQ ID NO: 97456 - RNA, 1701 nt, Artificial Sequence
  derived and/or modified sequence opt2 from hemagglutinin__InfluenzaA__ADN26165
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97457 - RNA, 1701 nt, Artificial Sequence; identical to SEQ ID NO: 94361
  derived and/or modified sequence opt2 from hemagglutinin__InfluenzaA__ADN26175

SEQ ID NO: 97458 - RNA, 1701 nt, Artificial Sequence
  derived and/or modified sequence opt2 from hemagglutinin__InfluenzaA__ADN78194
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggccuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97459 - RNA, 1701 nt, Artificial Sequence; identical to SEQ ID NO: 95345
  derived and/or modified sequence opt2 from hemagglutinin__InfluenzaA__ADN78195

SEQ ID NO: 97460 - RNA, 1701 nt, Artificial Sequence; identical to SEQ ID NO: 95733
  derived and/or modified sequence opt2 from hemagglutinin__InfluenzaA__ADN78212

SEQ ID NO: 97461 - RNA, 1701 nt, Artificial Sequence; identical to SEQ ID NO: 95733
  derived and/or modified sequence opt2 from hemagglutinin__InfluenzaA__ADN78221

SEQ ID NO: 97462 - RNA, 1698 nt, Artificial Sequence; identical to SEQ ID NO: 97452
  derived and/or modified sequence opt2 from hemagglutinin__InfluenzaA__ADN89050

SEQ ID NO: 97463 - RNA, 1698 nt, Artificial Sequence
  derived and/or modified sequence opt2 from hemagglutinin__InfluenzaA__ADN89061
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacgagaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97464 - RNA, 1698 nt, Artificial Sequence; identical to SEQ ID NO: 97454
  derived and/or modified sequence opt2 from hemagglutinin__InfluenzaA__ADN89072

SEQ ID NO: 97465 - RNA, 1698 nt, Artificial Sequence
  derived and/or modified sequence opt2 from hemagglutinin__InfluenzaA__ADN89083
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacauggccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97466 - RNA, 1698 nt, Artificial Sequence
  derived and/or modified sequence opt2 from hemagglutinin__InfluenzaA__ADN89094
augaaggucaagcuccucguccuccucugcaccuucaccgccaccuacgccgacaccaucugcaucggcuaccacgccaacaacuccaccgacaccgucgacaccgcccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaagggcaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97467 - RNA, 1698 nt, Artificial Sequence
  derived and/or modified sequence opt2 from hemagglutinin__InfluenzaA__ADN89116
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97468 - RNA, 1698 nt, Artificial Sequence
  derived and/or modified sequence opt2 from hemagglutinin__InfluenzaA__ADN89127
augaaggucaagcuccucguccuccucugcacccucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccgaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97469 - RNA, 1698 nt, Artificial Sequence
  derived and/or modified sequence opt2 from hemagglutinin__InfluenzaA__ADN89149
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgaggucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97470 - RNA, 1698 nt, Artificial Sequence; identical to SEQ ID NO: 97025
  derived and/or modified sequence opt2 from hemagglutinin__InfluenzaA__ADN89171

SEQ ID NO: 97471 - RNA, 1698 nt, Artificial Sequence
  derived and/or modified sequence opt2 from hemagglutinin__InfluenzaA__ADN89182
augaaggucaagcuccucguccuccucugcacccucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97472 - RNA, 1698 nt, Artificial Sequence; identical to SEQ ID NO: 97025
  derived and/or modified sequence opt2 from hemagglutinin__InfluenzaA__ADN89193

SEQ ID NO: 97473 - RNA, 1698 nt, Artificial Sequence; identical to SEQ ID NO: 97025
  derived and/or modified sequence opt2 from hemagglutinin__InfluenzaA__ADN89204

SEQ ID NO: 97474 - RNA, 1698 nt, Artificial Sequence; identical to SEQ ID NO: 97452
  derived and/or modified sequence opt2 from hemagglutinin__InfluenzaA__ADN89215

SEQ ID NO: 97475 - RNA, 1698 nt, Artificial Sequence
  derived and/or modified sequence opt2 from hemagglutinin__InfluenzaA__ADN89226
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucaaccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccguccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97476 - RNA, 1698 nt, Artificial Sequence; identical to SEQ ID NO: 97452
  derived and/or modified sequence opt2 from hemagglutinin__InfluenzaA__ADN89237

SEQ ID NO: 97477 - RNA, 1698 nt, Artificial Sequence
  derived and/or modified sequence opt2 from hemagglutinin__InfluenzaA__ADN89248
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccaucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97478 - RNA, 1698 nt, Artificial Sequence; identical to SEQ ID NO: 97465
  derived and/or modified sequence opt2 from hemagglutinin__InfluenzaA__ADN89259

SEQ ID NO: 97479 - RNA, 1698 nt, Artificial Sequence
  derived and/or modified sequence opt2 from hemagglutinin__InfluenzaA__ADN89281
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97480 - RNA, 1698 nt, Artificial Sequence; identical to SEQ ID NO: 97479
  derived and/or modified sequence opt2 from hemagglutinin__InfluenzaA__ADN89292

SEQ ID NO: 97481 - RNA, 1698 nt, Artificial Sequence; identical to SEQ ID NO: 97479
  derived and/or modified sequence opt2 from hemagglutinin__InfluenzaA__ADN89303

SEQ ID NO: 97482 - RNA, 1698 nt, Artificial Sequence; identical to SEQ ID NO: 95138
  derived and/or modified sequence opt2 from hemagglutinin__InfluenzaA__ADN89314

SEQ ID NO: 97483 - RNA, 1698 nt, Artificial Sequence; identical to SEQ ID NO: 94643
  derived and/or modified sequence opt2 from hemagglutinin__InfluenzaA__ADN89325

SEQ ID NO: 97484 - RNA, 1698 nt, Artificial Sequence
  derived and/or modified sequence opt2 from hemagglutinin__InfluenzaA__ADN89336
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccgacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97485 - RNA, 1698 nt, Artificial Sequence; identical to SEQ ID NO: 97475
  derived and/or modified sequence opt2 from hemagglutinin__InfluenzaA__ADN89347

SEQ ID NO: 97486 - RNA, 1698 nt, Artificial Sequence; identical to SEQ ID NO: 94643
  derived and/or modified sequence opt2 from hemagglutinin__InfluenzaA__ADN89358

SEQ ID NO: 97487 - RNA, 1698 nt, Artificial Sequence
  derived and/or modified sequence opt2 from hemagglutinin__InfluenzaA__ADN89369
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucauccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97488 - RNA, 1698 nt, Artificial Sequence
  derived and/or modified sequence opt2 from hemagglutinin__InfluenzaA__ADN89380
augaaggucaagcuccucguccuccucugcacccucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97489 - RNA, 1698 nt, Artificial Sequence
  derived and/or modified sequence opt2 from hemagglutinin__InfluenzaA__ADN89391
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuacaagaaccuccucuggcucaccggcaagaacggccucuaccccaaccucuccaaguccuacgccaacaacaaggagaaggagguccucguccucuggggcguccaccacccccccgacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97490 - RNA, 1698 nt, Artificial Sequence
  derived and/or modified sequence opt2 from hemagglutinin__InfluenzaA__ADN89402
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaagaaguccugguccuacaucgucgagaagcccaaccccgagaacggcaccugcuaccccggccacuucgccgacuacgaggagcucaaggagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97491 - RNA, 1698 nt, Artificial Sequence; identical to SEQ ID NO: 97452
  derived and/or modified sequence opt2 from hemagglutinin__InfluenzaA__ADN89413

SEQ ID NO: 97492 - RNA, 1698 nt, Artificial Sequence; identical to SEQ ID NO: 97025
  derived and/or modified sequence opt2 from hemagglutinin__InfluenzaA__ADN89424

SEQ ID NO: 97493 - RNA, 1698 nt, Artificial Sequence
  derived and/or modified sequence opt2 from hemagglutinin__InfluenzaA__ADN89435
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggagucccgccucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97494 - RNA, 1698 nt, Artificial Sequence
  derived and/or modified sequence opt2 from hemagglutinin__InfluenzaA__ADN89446
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97495 - RNA, 1698 nt, Artificial Sequence; identical to SEQ ID NO: 97025
  derived and/or modified sequence opt2 from hemagglutinin__InfluenzaA__ADN89457

SEQ ID NO: 97496 - RNA, 1698 nt, Artificial Sequence
  derived and/or modified sequence opt2 from hemagglutinin__InfluenzaA__ADN89468
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggacuccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucaccaucuacuccaccgucgccuccucccucguccuccucaucucccucggcgccaucuccuucuggaugugcuccaacggcucccuccagugccgcaucugcaucuga

SEQ ID NO: 97497 - RNA, 1698 nt, Artificial Sequence; identical to SEQ ID NO: 97454
  derived and/or modified sequence opt2 from hemagglutinin__InfluenzaA__ADN89479

SEQ ID NO: 97498 - RNA, 1698 nt, Artificial Sequence; identical to SEQ ID NO: 97454
  derived and/or modified sequence opt2 from hemagglutinin__InfluenzaA__ADN89490

SEQ ID NO: 97499 - RNA, 1698 nt, Artificial Sequence; identical to SEQ ID NO: 97477
  derived and/or modified sequence opt2 from hemagglutinin__InfluenzaA__ADN89501

SEQ ID NO: 97500 - RNA, 1698 nt, Artificial Sequence; identical to SEQ ID NO: 97465
  derived and/or modified sequence opt2 from hemagglutinin__InfluenzaA__ADN89512

SEQ ID NO: 97501 - RNA, 1698 nt, Artificial Sequence; identical to SEQ ID NO: 97479
  derived and/or modified sequence opt2 from hemagglutinin__InfluenzaA__ADN89523

SEQ ID NO: 97502 - RNA, 1698 nt, Artificial Sequence; identical to SEQ ID NO: 97488
  derived and/or modified sequence opt2 from hemagglutinin__InfluenzaA__ADN89534

SEQ ID NO: 97503 - RNA, 1698 nt, Artificial Sequence; identical to SEQ ID NO: 97493
  derived and/or modified sequence opt2 from hemagglutinin__InfluenzaA__ADN89545

SEQ ID NO: 97504 - RNA, 1698 nt, Artificial Sequence; identical to SEQ ID NO: 95138
  derived and/or modified sequence opt2 from hemagglutinin__InfluenzaA__ADN89556

SEQ ID NO: 97505 - RNA, 1698 nt, Artificial Sequence; identical to SEQ ID NO: 97454
  derived and/or modified sequence opt2 from hemagglutinin__InfluenzaA__ADN89567

SEQ ID NO: 97506 - RNA, 1698 nt, Artificial Sequence
  derived and/or modified sequence opt2 from hemagglutinin__InfluenzaA__ADN89578
augaaggucaagcuccucguccuccucugcacccucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccuccuccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97507 - RNA, 1698 nt, Artificial Sequence; identical to SEQ ID NO: 97025
  derived and/or modified sequence opt2 from hemagglutinin__InfluenzaA__ADN89589

SEQ ID NO: 97508 - RNA, 1698 nt, Artificial Sequence
  derived and/or modified sequence opt2 from hemagglutinin__InfluenzaA__ADN89600
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucacccgcaagaacggccucuaccccaaccucuccaaguccuacgccaacaacaaggagaaggagguccucguccucuggggcguccaccacccccccaacauggucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97509 - RNA, 1698 nt, Artificial Sequence; identical to SEQ ID NO: 97025
  derived and/or modified sequence opt2 from hemagglutinin__InfluenzaA__ADN89611

SEQ ID NO: 97510 - RNA, 1698 nt, Artificial Sequence; identical to SEQ ID NO: 97452
  derived and/or modified sequence opt2 from hemagglutinin__InfluenzaA__ADN89622

SEQ ID NO: 97511 - RNA, 1698 nt, Artificial Sequence; identical to SEQ ID NO: 97493
  derived and/or modified sequence opt2 from hemagglutinin__InfluenzaA__ADN89633

SEQ ID NO: 97512 - RNA, 1698 nt, Artificial Sequence; identical to SEQ ID NO: 97477
  derived and/or modified sequence opt2 from hemagglutinin__InfluenzaA__ADN89644

SEQ ID NO: 97513 - RNA, 1698 nt, Artificial Sequence; identical to SEQ ID NO: 97493
  derived and/or modified sequence opt2 from hemagglutinin__InfluenzaA__ADN89655

SEQ ID NO: 97514 - RNA, 1698 nt, Artificial Sequence; identical to SEQ ID NO: 97025
  derived and/or modified sequence opt2 from hemagglutinin__InfluenzaA__ADN89666

SEQ ID NO: 97515 - RNA, 1698 nt, Artificial Sequence; identical to SEQ ID NO: 97465
  derived and/or modified sequence opt2 from hemagglutinin__InfluenzaA__ADN89677

SEQ ID NO: 97516 - RNA, 1698 nt, Artificial Sequence; identical to SEQ ID NO: 97465
  derived and/or modified sequence opt2 from hemagglutinin__InfluenzaA__ADN89688

SEQ ID NO: 97517 - RNA, 1698 nt, Artificial Sequence; identical to SEQ ID NO: 97452
  derived and/or modified sequence opt2 from hemagglutinin__InfluenzaA__ADN89699

SEQ ID NO: 97518 - RNA, 1698 nt, Artificial Sequence; identical to SEQ ID NO: 97454
  derived and/or modified sequence opt2 from hemagglutinin__InfluenzaA__ADN89710

SEQ ID NO: 97519 - RNA, 1698 nt, Artificial Sequence; identical to SEQ ID NO: 97477
  derived and/or modified sequence opt2 from hemagglutinin__InfluenzaA__ADN89721

SEQ ID NO: 97520 - RNA, 1698 nt, Artificial Sequence; identical to SEQ ID NO: 97454
  derived and/or modified sequence opt2 from hemagglutinin__InfluenzaA__ADN89732

SEQ ID NO: 97521 - RNA, 1698 nt, Artificial Sequence; identical to SEQ ID NO: 97454
  derived and/or modified sequence opt2 from hemagglutinin__InfluenzaA__ADN89743

SEQ ID NO: 97522 - RNA, 1698 nt, Artificial Sequence; identical to SEQ ID NO: 97479
  derived and/or modified sequence opt2 from hemagglutinin__InfluenzaA__ADN89765

SEQ ID NO: 97523 - RNA, 1698 nt, Artificial Sequence
  derived and/or modified sequence opt2 from hemagglutinin__InfluenzaA__ADN89776
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgaggucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97524 - RNA, 1698 nt, Artificial Sequence; identical to SEQ ID NO: 97465
  derived and/or modified sequence opt2 from hemagglutinin__InfluenzaA__ADN89787

SEQ ID NO: 97525 - RNA, 1698 nt, Artificial Sequence; identical to SEQ ID NO: 97479
  derived and/or modified sequence opt2 from hemagglutinin__InfluenzaA__ADN89798

SEQ ID NO: 97526 - RNA, 1698 nt, Artificial Sequence; identical to SEQ ID NO: 97025
  derived and/or modified sequence opt2 from hemagglutinin__InfluenzaA__ADN89809

SEQ ID NO: 97527 - RNA, 1698 nt, Artificial Sequence; identical to SEQ ID NO: 97025
  derived and/or modified sequence opt2 from hemagglutinin__InfluenzaA__ADN89820

SEQ ID NO: 97528 - RNA, 1698 nt, Artificial Sequence; identical to SEQ ID NO: 97025
  derived and/or modified sequence opt2 from hemagglutinin__InfluenzaA__ADN89831

SEQ ID NO: 97529 - RNA, 1698 nt, Artificial Sequence
  derived and/or modified sequence opt2 from hemagglutinin__InfluenzaA__ADN89842
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaaccgccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97530 - RNA, 1701 nt, Artificial Sequence; identical to SEQ ID NO: 97045
  derived and/or modified sequence opt2 from hemagglutinin__InfluenzaA__ADN89864

SEQ ID NO: 97531 - RNA, 1701 nt, Artificial Sequence; identical to SEQ ID NO: 97045
  derived and/or modified sequence opt2 from hemagglutinin__InfluenzaA__ADN89875

SEQ ID NO: 97532 - RNA, 1701 nt, Artificial Sequence
  derived and/or modified sequence opt2 from hemagglutinin__InfluenzaA__ADN89886
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97533 - RNA, 1701 nt, Artificial Sequence; identical to SEQ ID NO: 97045
  derived and/or modified sequence opt2 from hemagglutinin__InfluenzaA__ADN89897

SEQ ID NO: 97534 - RNA, 1701 nt, Artificial Sequence; identical to SEQ ID NO: 97045
  derived and/or modified sequence opt2 from hemagglutinin__InfluenzaA__ADN89908

SEQ ID NO: 97535 - RNA, 1701 nt, Artificial Sequence; identical to SEQ ID NO: 97045
  derived and/or modified sequence opt2 from hemagglutinin__InfluenzaA__ADN89919

SEQ ID NO: 97536 - RNA, 1701 nt, Artificial Sequence; identical to SEQ ID NO: 97045
  derived and/or modified sequence opt2 from hemagglutinin__InfluenzaA__ADN89930

SEQ ID NO: 97537 - RNA, 1701 nt, Artificial Sequence; identical to SEQ ID NO: 97045
  derived and/or modified sequence opt2 from hemagglutinin__InfluenzaA__ADN89941

SEQ ID NO: 97538 - RNA, 1701 nt, Artificial Sequence; identical to SEQ ID NO: 97045
  derived and/or modified sequence opt2 from hemagglutinin__InfluenzaA__ADN89952

SEQ ID NO: 97539 - RNA, 1701 nt, Artificial Sequence; identical to SEQ ID NO: 97045
  derived and/or modified sequence opt2 from hemagglutinin__InfluenzaA__ADN89963

SEQ ID NO: 97540 - RNA, 1701 nt, Artificial Sequence
  derived and/or modified sequence opt2 from hemagglutinin__InfluenzaA__ADN89974
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97541 - RNA, 1701 nt, Artificial Sequence; identical to SEQ ID NO: 97045
  derived and/or modified sequence opt2 from hemagglutinin__InfluenzaA__ADN89985

SEQ ID NO: 97542 - RNA, 1701 nt, Artificial Sequence; identical to SEQ ID NO: 97045
  derived and/or modified sequence opt2 from hemagglutinin__InfluenzaA__ADN89996

SEQ ID NO: 97543 - RNA, 1701 nt, Artificial Sequence; identical to SEQ ID NO: 97045
  derived and/or modified sequence opt2 from hemagglutinin__InfluenzaA__ADN90007

SEQ ID NO: 97544 - RNA, 1701 nt, Artificial Sequence; identical to SEQ ID NO: 97045
  derived and/or modified sequence opt2 from hemagglutinin__InfluenzaA__ADN90018

SEQ ID NO: 97545 - RNA, 1701 nt, Artificial Sequence; identical to SEQ ID NO: 97045
  derived and/or modified sequence opt2 from hemagglutinin__InfluenzaA__ADN90040

SEQ ID NO: 97546 - RNA, 1701 nt, Artificial Sequence; identical to SEQ ID NO: 97045
  derived and/or modified sequence opt2 from hemagglutinin__InfluenzaA__ADN90051

SEQ ID NO: 97547 - RNA, 1701 nt, Artificial Sequence; identical to SEQ ID NO: 97045
  derived and/or modified sequence opt2 from hemagglutinin__InfluenzaA__ADN90062

SEQ ID NO: 97548 - RNA, 1701 nt, Artificial Sequence; identical to SEQ ID NO: 97045
  derived and/or modified sequence opt2 from hemagglutinin__InfluenzaA__ADN90073

SEQ ID NO: 97549 - RNA, 1701 nt, Artificial Sequence; identical to SEQ ID NO: 97045
  derived and/or modified sequence opt2 from hemagglutinin__InfluenzaA__ADN90084

SEQ ID NO: 97550 - RNA, 1701 nt, Artificial Sequence; identical to SEQ ID NO: 97045
  derived and/or modified sequence opt2 from hemagglutinin__InfluenzaA__ADN90095

SEQ ID NO: 97551 - RNA, 1701 nt, Artificial Sequence; identical to SEQ ID NO: 97045
  derived and/or modified sequence opt2 from hemagglutinin__InfluenzaA__ADN90106

SEQ ID NO: 97552 - RNA, 1701 nt, Artificial Sequence; identical to SEQ ID NO: 97045
  derived and/or modified sequence opt2 from hemagglutinin__InfluenzaA__ADN90117

SEQ ID NO: 97553 - RNA, 1701 nt, Artificial Sequence; identical to SEQ ID NO: 97045
  derived and/or modified sequence opt2 from hemagglutinin__InfluenzaA__ADN90128

SEQ ID NO: 97554 - RNA, 1701 nt, Artificial Sequence; identical to SEQ ID NO: 97045
  derived and/or modified sequence opt2 from hemagglutinin__InfluenzaA__ADN90139

SEQ ID NO: 97555 - RNA, 1701 nt, Artificial Sequence; identical to SEQ ID NO: 97045
  derived and/or modified sequence opt2 from hemagglutinin__InfluenzaA__ADN90150

SEQ ID NO: 97556 - RNA, 1701 nt, Artificial Sequence; identical to SEQ ID NO: 97045
  derived and/or modified sequence opt2 from hemagglutinin__InfluenzaA__ADN90161

SEQ ID NO: 97557 - RNA, 1701 nt, Artificial Sequence; identical to SEQ ID NO: 97045
  derived and/or modified sequence opt2 from hemagglutinin__InfluenzaA__ADN90172

SEQ ID NO: 97558 - RNA, 1701 nt, Artificial Sequence; identical to SEQ ID NO: 97045
  derived and/or modified sequence opt2 from hemagglutinin__InfluenzaA__ADN90183

SEQ ID NO: 97559 - RNA, 1701 nt, Artificial Sequence; identical to SEQ ID NO: 97045
  derived and/or modified sequence opt2 from hemagglutinin__InfluenzaA__ADN90194

SEQ ID NO: 97560 - RNA, 1701 nt, Artificial Sequence; identical to SEQ ID NO: 97045
  derived and/or modified sequence opt2 from hemagglutinin__InfluenzaA__ADN90205

SEQ ID NO: 97561 - RNA, 1701 nt, Artificial Sequence; identical to SEQ ID NO: 97045
  derived and/or modified sequence opt2 from hemagglutinin__InfluenzaA__ADN90216

SEQ ID NO: 97562 - RNA, 1701 nt, Artificial Sequence; identical to SEQ ID NO: 94942
  derived and/or modified sequence opt2 from hemagglutinin__InfluenzaA__ADN92467

SEQ ID NO: 97563 - RNA, 1701 nt, Artificial Sequence
  derived and/or modified sequence opt2 from hemagglutinin__InfluenzaA__ADN92478
augaagaccaucaucgcccucucccacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccaggcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97564 - RNA, 1701 nt, Artificial Sequence
  derived and/or modified sequence opt2 from hemagglutinin__InfluenzaA__ADN92489
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaagaacuccuucuucucccgccucaacuggcucacccaccucaacuucaaguaccaggcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97565 - RNA, 1701 nt, Artificial Sequence; identical to SEQ ID NO: 94942
  derived and/or modified sequence opt2 from hemagglutinin__InfluenzaA__ADN92500

SEQ ID NO: 97566 - RNA, 1701 nt, Artificial Sequence; identical to SEQ ID NO: 94181
  derived and/or modified sequence opt2 from hemagglutinin__InfluenzaA__ADN92510

SEQ ID NO: 97567 - RNA, 1701 nt, Artificial Sequence; identical to SEQ ID NO: 94181
  derived and/or modified sequence opt2 from hemagglutinin__InfluenzaA__ADN92520

SEQ ID NO: 97568 - RNA, 1701 nt, Artificial Sequence; identical to SEQ ID NO: 95283
  derived and/or modified sequence opt2 from hemagglutinin__InfluenzaA__ADN92530

SEQ ID NO: 97569 - RNA, 1701 nt, Artificial Sequence; identical to SEQ ID NO: 94423
  derived and/or modified sequence opt2 from hemagglutinin__InfluenzaA__ADN92540

SEQ ID NO: 97570 - RNA, 1701 nt, Artificial Sequence; identical to SEQ ID NO: 94181
  derived and/or modified sequence opt2 from hemagglutinin__InfluenzaA__ADN92550

SEQ ID NO: 97571 - RNA, 1701 nt, Artificial Sequence; identical to SEQ ID NO: 94181
  derived and/or modified sequence opt2 from hemagglutinin__InfluenzaA__ADN92560

SEQ ID NO: 97572 - RNA, 1701 nt, Artificial Sequence
  derived and/or modified sequence opt2 from hemagglutinin__InfluenzaA__ADO00730
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcggcucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97573 - RNA, 1701 nt, Artificial Sequence; identical to SEQ ID NO: 95601
  derived and/or modified sequence opt2 from hemagglutinin__InfluenzaA__ADO00740

SEQ ID NO: 97574 - RNA, 1701 nt, Artificial Sequence; identical to SEQ ID NO: 95345
  derived and/or modified sequence opt2 from hemagglutinin__InfluenzaA__ADO00750

SEQ ID NO: 97575 - RNA, 1701 nt, Artificial Sequence; identical to SEQ ID NO: 94181
  derived and/or modified sequence opt2 from hemagglutinin__InfluenzaA__ADO12143

SEQ ID NO: 97576 - RNA, 1701 nt, Artificial Sequence; identical to SEQ ID NO: 94181
  derived and/or modified sequence opt2 from hemagglutinin__InfluenzaA__ADO12153

SEQ ID NO: 97577 - RNA, 1701 nt, Artificial Sequence; identical to SEQ ID NO: 94181
  derived and/or modified sequence opt2 from hemagglutinin__InfluenzaA__ADO12163

SEQ ID NO: 97578 - RNA, 1701 nt, Artificial Sequence; identical to SEQ ID NO: 94181
  derived and/or modified sequence opt2 from hemagglutinin__InfluenzaA__ADO12173

SEQ ID NO: 97579 - RNA, 1701 nt, Artificial Sequence; identical to SEQ ID NO: 94181
  derived and/or modified sequence opt2 from hemagglutinin__InfluenzaA__ADO12183

SEQ ID NO: 97580 - RNA, 1701 nt, Artificial Sequence; identical to SEQ ID NO: 94181
  derived and/or modified sequence opt2 from hemagglutinin__InfluenzaA__ADO12193

SEQ ID NO: 97581 - RNA, 1701 nt, Artificial Sequence; identical to SEQ ID NO: 94181
  derived and/or modified sequence opt2 from hemagglutinin__InfluenzaA__ADO12203

SEQ ID NO: 97582 - RNA, 1701 nt, Artificial Sequence; identical to SEQ ID NO: 94181
  derived and/or modified sequence opt2 from hemagglutinin__InfluenzaA__ADO12213

SEQ ID NO: 97583 - RNA, 1701 nt, Artificial Sequence; identical to SEQ ID NO: 94181
  derived and/or modified sequence opt2 from hemagglutinin__InfluenzaA__ADO12223

SEQ ID NO: 97584 - RNA, 1701 nt, Artificial Sequence; identical to SEQ ID NO: 94181
  derived and/or modified sequence opt2 from hemagglutinin__InfluenzaA__ADO12233

SEQ ID NO: 97585 - RNA, 1701 nt, Artificial Sequence; identical to SEQ ID NO: 94181
  derived and/or modified sequence opt2 from hemagglutinin__InfluenzaA__ADO12243

SEQ ID NO: 97586 - RNA, 1701 nt, Artificial Sequence; identical to SEQ ID NO: 94181
  derived and/or modified sequence opt2 from hemagglutinin__InfluenzaA__ADO12253

SEQ ID NO: 97587 - RNA, 1701 nt, Artificial Sequence; identical to SEQ ID NO: 94181
  derived and/or modified sequence opt2 from hemagglutinin__InfluenzaA__ADO12263

SEQ ID NO: 97588 - RNA, 1701 nt, Artificial Sequence; identical to SEQ ID NO: 94181
  derived and/or modified sequence opt2 from hemagglutinin__InfluenzaA__ADO12273

SEQ ID NO: 97589 - RNA, 1701 nt, Artificial Sequence; identical to SEQ ID NO: 94181
  derived and/or modified sequence opt2 from hemagglutinin__InfluenzaA__ADO12283

SEQ ID NO: 97590 - RNA, 1701 nt, Artificial Sequence; identical to SEQ ID NO: 94181
  derived and/or modified sequence opt2 from hemagglutinin__InfluenzaA__ADO12293

SEQ ID NO: 97591 - RNA, 1701 nt, Artificial Sequence; identical to SEQ ID NO: 94181
  derived and/or modified sequence opt2 from hemagglutinin__InfluenzaA__ADO12303

SEQ ID NO: 97592 - RNA, 1701 nt, Artificial Sequence; identical to SEQ ID NO: 94181
  derived and/or modified sequence opt2 from hemagglutinin__InfluenzaA__ADO12313

SEQ ID NO: 97593 - RNA, 1701 nt, Artificial Sequence; identical to SEQ ID NO: 94181
  derived and/or modified sequence opt2 from hemagglutinin__InfluenzaA__ADO12323

SEQ ID NO: 97594 - RNA, 1701 nt, Artificial Sequence; identical to SEQ ID NO: 94181
  derived and/or modified sequence opt2 from hemagglutinin__InfluenzaA__ADO12333

SEQ ID NO: 97595 - RNA, 1701 nt, Artificial Sequence; identical to SEQ ID NO: 94181
  derived and/or modified sequence opt2 from hemagglutinin__InfluenzaA__ADO12343

SEQ ID NO: 97596 - RNA, 1701 nt, Artificial Sequence; identical to SEQ ID NO: 94181
  derived and/or modified sequence opt2 from hemagglutinin__InfluenzaA__ADO12353

SEQ ID NO: 97597 - RNA, 1701 nt, Artificial Sequence; identical to SEQ ID NO: 94181
  derived and/or modified sequence opt2 from hemagglutinin__InfluenzaA__ADO12363

SEQ ID NO: 97598 - RNA, 1701 nt, Artificial Sequence
  derived and/or modified sequence opt2 from hemagglutinin__InfluenzaA__ADO12373
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacaacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97599 - RNA, 1701 nt, Artificial Sequence; identical to SEQ ID NO: 95666
  derived and/or modified sequence opt2 from hemagglutinin__InfluenzaA__ADO12383

SEQ ID NO: 97600 - RNA, 1701 nt, Artificial Sequence
  derived and/or modified sequence opt2 from hemagglutinin__InfluenzaA__ADO12403
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97601 - RNA, 1701 nt, Artificial Sequence; identical to SEQ ID NO: 95817
  derived and/or modified sequence opt2 from hemagglutinin__InfluenzaA__ADO12413

SEQ ID NO: 97602 - RNA, 1701 nt, Artificial Sequence; identical to SEQ ID NO: 94181
  derived and/or modified sequence opt2 from hemagglutinin__InfluenzaA__ADO12423

SEQ ID NO: 97603 - RNA, 1701 nt, Artificial Sequence; identical to SEQ ID NO: 94181
  derived and/or modified sequence opt2 from hemagglutinin__InfluenzaA__ADO12433

SEQ ID NO: 97604 - RNA, 1701 nt, Artificial Sequence; identical to SEQ ID NO: 94181
  derived and/or modified sequence opt2 from hemagglutinin__InfluenzaA__ADO12443

SEQ ID NO: 97605 - RNA, 1701 nt, Artificial Sequence; identical to SEQ ID NO: 94181
  derived and/or modified sequence opt2 from hemagglutinin__InfluenzaA__ADO12453

SEQ ID NO: 97606 - RNA, 1701 nt, Artificial Sequence; identical to SEQ ID NO: 94181
  derived and/or modified sequence opt2 from hemagglutinin__InfluenzaA__ADO12463

SEQ ID NO: 97607 - RNA, 1701 nt, Artificial Sequence
  derived and/or modified sequence opt2 from hemagglutinin__InfluenzaA__ADO12473
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcagaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97608 - RNA, 1701 nt, Artificial Sequence; identical to SEQ ID NO: 94181
  derived and/or modified sequence opt2 from hemagglutinin__InfluenzaA__ADO12493

SEQ ID NO: 97609 - RNA, 1701 nt, Artificial Sequence
  derived and/or modified sequence opt2 from hemagglutinin__InfluenzaA__ADO12503
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucaacuucuggaugugcuccaacggcucccuccagugccgcaucugcaucuga

SEQ ID NO: 97610 - RNA, 1701 nt, Artificial Sequence
  derived and/or modified sequence opt2 from hemagglutinin__InfluenzaA__ADO12513
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcgaggucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97611 - RNA, 1701 nt, Artificial Sequence; identical to SEQ ID NO: 94181
  derived and/or modified sequence opt2 from hemagglutinin__InfluenzaA__ADO12523

SEQ ID NO: 97612 - RNA, 1701 nt, Artificial Sequence
  derived and/or modified sequence opt2 from hemagglutinin__InfluenzaA__ADO12533
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccacccgccuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97613 - RNA, 1701 nt, Artificial Sequence; identical to SEQ ID NO: 94181
  derived and/or modified sequence opt2 from hemagglutinin__InfluenzaA__ADO12543

SEQ ID NO: 97614 - RNA, 1701 nt, Artificial Sequence; identical to SEQ ID NO: 94181
  derived and/or modified sequence opt2 from hemagglutinin__InfluenzaA__ADO12553

SEQ ID NO: 97615 - RNA, 1701 nt, Artificial Sequence; identical to SEQ ID NO: 94181
  derived and/or modified sequence opt2 from hemagglutinin__InfluenzaA__ADO12563

SEQ ID NO: 97616 - RNA, 1701 nt, Artificial Sequence; identical to SEQ ID NO: 94181
  derived and/or modified sequence opt2 from hemagglutinin__InfluenzaA__ADO12573

SEQ ID NO: 97617 - RNA, 1701 nt, Artificial Sequence
  derived and/or modified sequence opt2 from hemagglutinin__InfluenzaA__ADO12593
augaaggccauccucgucguccuccucuacaccuucgccaccgccaacgccgacacccucugcaucggcuaccacgccaacaacuccaccgacaucgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97618 - RNA, 1701 nt, Artificial Sequence; identical to SEQ ID NO: 94181
  derived and/or modified sequence opt2 from hemagglutinin__InfluenzaA__ADO12603

SEQ ID NO: 97619 - RNA, 1701 nt, Artificial Sequence; identical to SEQ ID NO: 94181
  derived and/or modified sequence opt2 from hemagglutinin__InfluenzaA__ADO12613

SEQ ID NO: 97620 - RNA, 1701 nt, Artificial Sequence; identical to SEQ ID NO: 94181
  derived and/or modified sequence opt2 from hemagglutinin__InfluenzaA__ADO12623

SEQ ID NO: 97621 - RNA, 1701 nt, Artificial Sequence
  derived and/or modified sequence opt2 from hemagglutinin__InfluenzaA__ADO14349
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaagggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaagggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97622 - RNA, 1701 nt, Artificial Sequence; identical to SEQ ID NO: 96445
  derived and/or modified sequence opt2 from hemagglutinin__InfluenzaA__ADO14351

SEQ ID NO: 97623 - RNA, 1701 nt, Artificial Sequence
  derived and/or modified sequence opt2 from hemagglutinin__InfluenzaA__ADO14353
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97624 - RNA, 1701 nt, Artificial Sequence
  derived and/or modified sequence opt2 from hemagglutinin__InfluenzaA__ADO14354
augaaggccauccucgucguccuccucuacaccuucgccaccgccaacgccgacacccucugcaugggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97625 - RNA, 1701 nt, Artificial Sequence
  derived and/or modified sequence opt2 from hemagglutinin__InfluenzaA__ADO14356
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccgaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97626 - RNA, 1701 nt, Artificial Sequence; identical to SEQ ID NO: 96445
  derived and/or modified sequence opt2 from hemagglutinin__InfluenzaA__ADO14357

SEQ ID NO: 97627 - RNA, 1701 nt, Artificial Sequence
  derived and/or modified sequence opt2 from hemagglutinin__InfluenzaA__ADO14359
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97628 - RNA, 1701 nt, Artificial Sequence
  derived and/or modified sequence opt2 from hemagglutinin__InfluenzaA__ADO14361
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaagggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97629 - RNA, 1701 nt, Artificial Sequence
  derived and/or modified sequence opt2 from hemagglutinin__InfluenzaA__ADO14362
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaacuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97630 - RNA, 1683 nt, Artificial Sequence
  derived and/or modified sequence opt2 from hemagglutinin__InfluenzaA__ADO21015
auggaggucgucucccucaucaccauccuccuccucgucaccgucuccaacgccgacaagaucugcaucggcuaccaguccaccaacuccaccgagaccgucgacacccucaccgagaacaacguccccgucgcccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccggcaccaucuggaacgucuccuacggcggcaccuccaaggccugcuccgacuccuucuacaaguccaugcgcuggcucacccagaagaacaacgccuaccccauccaggacgcccaguacaccaacaaccgcggcaagaacauccucuucauguggggcaucaaccacccccccaccgacaccacccagaccaaccucuacacccgcaccgacaccaccaccuccgucgccaccgaggacaucaaccgcaccuucaagccccucaucggcccccgcccccucgucaacggccagcagggccgcaucgacuacuacugguccguccucaagcccggccagacccuccgcguccgcuccaacggcaaccucaucgcccccugguacggccacauccucuccggcgagucccacggccgcauccucaagaccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 97631 - RNA, 1683 nt, Artificial Sequence
  derived and/or modified sequence opt2 from hemagglutinin__InfluenzaA__ADO21026
auggaggucgucucccucaucaccauccuccuccucgucaccgucuccaacgccgacaagaucugcaucggcuaccaguccaccaacuccaccgagaccgucgacacccucaccgagaacaacguccccgucgcccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccggcaccaucuggaacgucuccuacggcggcaccuccaaggccugcuccgacuccuucuacaaguccaugcgcuggcucacccagaagaacaacgccuaccccauccaggacgcccaguacaccaacaaccgcggcaagaacauccucuucauguggggcaucaaccacccccccaccgacaccacccagaccaaccucuacacccgcaccgacaccaccaccuccgucgccaccgaggacaucaaccgcaccuucaacccccucaucggcccccgcccccucgucaacggccagcagggccgcaucgacuacuacugguccguccucaagcccggccagacccuccgcguccgcuccaacggcaaccucaucgcccccugguacggccacauccucuccggcgagucccacggccgcauccucaagaccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaucaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 97632 - RNA, 1683 nt, Artificial Sequence
  derived and/or modified sequence opt2 from hemagglutinin__InfluenzaA__ADO21037
auggaggucgucucccucaucaccauccuccuccucgucaccgucuccaacgccgacaagaucugcaucggcuaccaguccaccaacuccaccgagaccgucgacacccucaccgagaacaacguccccgucgcccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccggcaccaucuggaacgucuccuacggcggcaccuccaaggccugcuccgacuccuucuacaaguccaugcgcuggcucacccagaagaacaacgccuaccccauccaggacgcccaguacaccaacaaccgcggcaagaacauccucuucauguggggcaucaaccacccccccaccgacaccacccagaccaaccucuacacccgcaccgacaccaccaccuccgucgccaccgaggacaucaaccgcaccuucaagcccuacaucggcccccgcccccucgucaacggccagcagggccgcaucgacuacuacugguccguccucaagcccggccagacccuccgcguccgcuccaacggcaaccucaucgcccccugguacggccacauccucuccggcgagucccacggccgcauccucaagaccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcgucggcauggccgccgaccgcgaccucacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 97633 - RNA, 1683 nt, Artificial Sequence
  derived and/or modified sequence opt2 from hemagglutinin__InfluenzaA__ADO21048
auggaggucgucucccucaucaccauccuccuccucgucaccgucuccaacgccgacaagaucugcaucggcuaccaguccaccaacuccaccgagaccgucgacacccucaccgagaacaacguccccgucgcccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccggcaccaucuggaacgucuccuacggcggcaccuccaaggccugcuccgacuccuucuacaaguccaugcgcuggcucacccagaagaacaacgccuaccccauccaggacgcccaguacaccaacaaccgcggcaagaacauccacuucauguggggcaucaaccacccccccaccgacaccacccagaccaaccucuacacccgcaccgacaccaccaccuccgucgccaccgaggacaucaaccgcaccuucaagccccucaucggcccccgcccccucgucaacggccagcagggccgcaucgacuacuacugguccguccucaagcccggccagacccuccgcguccgcuccaacggcaaccucaucgcccccugguacggccacauccucuccggcgagucccacggccgcauccucaagaccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcgucggcauggccgccgaccgcgucuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 97634 - RNA, 1701 nt, Artificial Sequence
  derived and/or modified sequence opt2 from hemagglutinin__InfluenzaA__ADO25092
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaacuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97635 - RNA, 1701 nt, Artificial Sequence; identical to SEQ ID NO: 96053
  derived and/or modified sequence opt2 from hemagglutinin__InfluenzaA__ADO25112

SEQ ID NO: 97636 - RNA, 1701 nt, Artificial Sequence; identical to SEQ ID NO: 96053
  derived and/or modified sequence opt2 from hemagglutinin__InfluenzaA__ADO25122

SEQ ID NO: 97637 - RNA, 1701 nt, Artificial Sequence
  derived and/or modified sequence opt2 from hemagglutinin__InfluenzaA__ADO25132
augaacgccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccgacaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97638 - RNA, 1701 nt, Artificial Sequence; identical to SEQ ID NO: 95794
  derived and/or modified sequence opt2 from hemagglutinin__InfluenzaA__ADO25142

SEQ ID NO: 97639 - RNA, 1701 nt, Artificial Sequence
  derived and/or modified sequence opt2 from hemagglutinin__InfluenzaA__ADO25152
augaaggccauccucgucguccuccucuacaccuucgccgccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucucccucuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97640 - RNA, 1701 nt, Artificial Sequence; identical to SEQ ID NO: 95733
  derived and/or modified sequence opt2 from hemagglutinin__InfluenzaA__ADO25162

SEQ ID NO: 97641 - RNA, 1701 nt, Artificial Sequence; identical to SEQ ID NO: 95733
  derived and/or modified sequence opt2 from hemagglutinin__InfluenzaA__ADO25172

SEQ ID NO: 97642 - RNA, 1701 nt, Artificial Sequence; identical to SEQ ID NO: 95733
  derived and/or modified sequence opt2 from hemagglutinin__InfluenzaA__ADO25182

SEQ ID NO: 97643 - RNA, 1701 nt, Artificial Sequence; identical to SEQ ID NO: 94181
  derived and/or modified sequence opt2 from hemagglutinin__InfluenzaA__ADO25192

SEQ ID NO: 97644 - RNA, 1701 nt, Artificial Sequence; identical to SEQ ID NO: 94181
  derived and/or modified sequence opt2 from hemagglutinin__InfluenzaA__ADO25202

SEQ ID NO: 97645 - RNA, 1701 nt, Artificial Sequence
  derived and/or modified sequence opt2 from hemagglutinin__InfluenzaA__ADO25212
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97646 - RNA, 1701 nt, Artificial Sequence
  derived and/or modified sequence opt2 from hemagglutinin__InfluenzaA__ADO25222
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97647 - RNA, 1701 nt, Artificial Sequence; identical to SEQ ID NO: 95794
  derived and/or modified sequence opt2 from hemagglutinin__InfluenzaA__ADO25232

SEQ ID NO: 97648 - RNA, 1701 nt, Artificial Sequence; identical to SEQ ID NO: 95733
  derived and/or modified sequence opt2 from hemagglutinin__InfluenzaA__ADO25242

SEQ ID NO: 97649 - RNA, 1701 nt, Artificial Sequence; identical to SEQ ID NO: 95811
  derived and/or modified sequence opt2 from hemagglutinin__InfluenzaA__ADO25252

SEQ ID NO: 97650 - RNA, 1701 nt, Artificial Sequence; identical to SEQ ID NO: 96053
  derived and/or modified sequence opt2 from hemagglutinin__InfluenzaA__ADO25262

SEQ ID NO: 97651 - RNA, 1701 nt, Artificial Sequence
  derived and/or modified sequence opt2 from hemagglutinin__InfluenzaA__ADO25272
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgucaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97652 - RNA, 1701 nt, Artificial Sequence; identical to SEQ ID NO: 95794
  derived and/or modified sequence opt2 from hemagglutinin__InfluenzaA__ADO25282

SEQ ID NO: 97653 - RNA, 1698 nt, Artificial Sequence; identical to SEQ ID NO: 94000
  derived and/or modified sequence opt2 from hemagglutinin__InfluenzaA__ADO27622

SEQ ID NO: 97654 - RNA, 1701 nt, Artificial Sequence; identical to SEQ ID NO: 94181
  derived and/or modified sequence opt2 from hemagglutinin__InfluenzaA__ADO29887

SEQ ID NO: 97655 - RNA, 1701 nt, Artificial Sequence
  derived and/or modified sequence opt2 from hemagglutinin__InfluenzaA__ADO29888
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccgccuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97656 - RNA, 1701 nt, Artificial Sequence
  derived and/or modified sequence opt2 from hemagglutinin__InfluenzaA__ADO29889
augaaggccauccucgucguccuccucuacaccuucgccaccgccaacgccgacauccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97657 - RNA, 1701 nt, Artificial Sequence
  derived and/or modified sequence opt2 from hemagglutinin__InfluenzaA__ADO29890
augaaggccauccucgucguccuccucuacaccuucgccaccgccaaggccgacacccucugcaucggcuaccacgccaacaacuccgccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgucgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97658 - RNA, 1701 nt, Artificial Sequence
  derived and/or modified sequence opt2 from hemagglutinin__InfluenzaA__ADO29891
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaccaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccucuccgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97659 - RNA, 1701 nt, Artificial Sequence
  derived and/or modified sequence opt2 from hemagglutinin__InfluenzaA__ADO29892
augaaggccauccucgucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggccgcauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgucgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97660 - RNA, 1701 nt, Artificial Sequence; identical to SEQ ID NO: 94979
  derived and/or modified sequence opt2 from hemagglutinin__InfluenzaA__ADO29893

SEQ ID NO: 97661 - RNA, 1701 nt, Artificial Sequence
  derived and/or modified sequence opt2 from hemagglutinin__InfluenzaA__ADO29894
augaaggccauccucgucguccuccucuacaccuucgccaccgccaacgccgacacccucugcaucggcuaccacgccaacaacuccaccgacaccgucgacaccguccucgagaugaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcuccuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97662 - RNA, 1701 nt, Artificial Sequence
  derived and/or modified sequence opt2 from hemagglutinin__InfluenzaA__ADO29895
augaaggccauccucgucgcccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcuccuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaagggcaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggagcgcgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97663 - RNA, 1701 nt, Artificial Sequence
  derived and/or modified sequence opt2 from hemagglutinin__InfluenzaA__ADO29897
augaaggccauccucgucguccuccucuacaccuucgccaccgccaacgccgacauccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaagugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuacccccgccucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacggcugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccgucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97664 - RNA, 1701 nt, Artificial Sequence; identical to SEQ ID NO: 94979
  derived and/or modified sequence opt2 from hemagglutinin__InfluenzaA__ADO29898

SEQ ID NO: 97665 - RNA, 1701 nt, Artificial Sequence
  derived and/or modified sequence opt2 from hemagglutinin__InfluenzaA__ADO29899
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaccugcaucuga

SEQ ID NO: 97666 - RNA, 1701 nt, Artificial Sequence
  derived and/or modified sequence opt2 from hemagglutinin__InfluenzaA__ADO29900
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgaccucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguccaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacguccgcuccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucugggccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97667 - RNA, 1701 nt, Artificial Sequence
  derived and/or modified sequence opt2 from hemagglutinin__InfluenzaA__ADO29901
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgccaagaagggcaacuccuaccccaaggucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuucaacggcucccuccagugccgcaucugcaucuga

SEQ ID NO: 97668 - RNA, 1701 nt, Artificial Sequence
  derived and/or modified sequence opt2 from hemagglutinin__InfluenzaA__ADO29902
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggagggcgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97669 - RNA, 1701 nt, Artificial Sequence
  derived and/or modified sequence opt2 from hemagglutinin__InfluenzaA__ADO29903
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaccgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97670 - RNA, 1701 nt, Artificial Sequence
  derived and/or modified sequence opt2 from hemagglutinin__InfluenzaA__ADO29904
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggccgcugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccgccccuccaccuccgccgaccagcagucccucuaccagaacgccgacgccuacgucuucgucggcaccucccgcuacuccaagaaguucaagcccgagaucgccauccgccccaaggucggcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccaacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97671 - RNA, 1701 nt, Artificial Sequence
  derived and/or modified sequence opt2 from hemagglutinin__InfluenzaA__ADO29905
augaaggccauccucgucguccuccucuacaccuucgccaccgccaacgccgacacccucugcaucggcuaccacgccaacaacuccaccgacaccgucgacaccguccucgagaagaacgucaccgucacccgcuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccaacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97672 - RNA, 1701 nt, Artificial Sequence
  derived and/or modified sequence opt2 from hemagglutinin__InfluenzaA__ADO29906
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaaccgcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97673 - RNA, 1701 nt, Artificial Sequence
  derived and/or modified sequence opt2 from hemagglutinin__InfluenzaA__ADO29907
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaagcucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97674 - RNA, 1701 nt, Artificial Sequence
  derived and/or modified sequence opt2 from hemagglutinin__InfluenzaA__ADO29908
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggaguggcgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaccuacuccaccgucgccuccucccucguccucgucgucucccucggcgccaucuccuucuggaugugcuccaacggcucccuccagugccgcaucugcaucuga

SEQ ID NO: 97675 - RNA, 1701 nt, Artificial Sequence
  derived and/or modified sequence opt2 from hemagglutinin__InfluenzaA__ADO29909
augaaggccauccucgucguccuccucuacaccuucgccaccgccaacgccgacacccuccgcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccauccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 97676 - RNA, 1701 nt, Artificial Sequence
  derived and/or modified sequence opt2 from hemagglutinin__InfluenzaA__ADO29910
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagccccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaucggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcggcgagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97677 - RNA, 1701 nt, Artificial Sequence; identical to SEQ ID NO: 95903
  derived and/or modified sequence opt2 from hemagglutinin__InfluenzaA__ADO30407

SEQ ID NO: 97678 - RNA, 1701 nt, Artificial Sequence; identical to SEQ ID NO: 95794
  derived and/or modified sequence opt2 from hemagglutinin__InfluenzaA__ADO30417

SEQ ID NO: 97679 - RNA, 1701 nt, Artificial Sequence; identical to SEQ ID NO: 95516
  derived and/or modified sequence opt2 from hemagglutinin__InfluenzaA__ADO33202

SEQ ID NO: 97680 - RNA, 1701 nt, Artificial Sequence; identical to SEQ ID NO: 95024
  derived and/or modified sequence opt2 from hemagglutinin__InfluenzaA__ADO33240

SEQ ID NO: 97681 - RNA, 1701 nt, Artificial Sequence; identical to SEQ ID NO: 94181
  derived and/or modified sequence opt2 from hemagglutinin__InfluenzaA__ADO33247

SEQ ID NO: 97682 - RNA, 1701 nt, Artificial Sequence; identical to SEQ ID NO: 95024
  derived and/or modified sequence opt2 from hemagglutinin__InfluenzaA__ADO33254

SEQ ID NO: 97683 - RNA, 1701 nt, Artificial Sequence; identical to SEQ ID NO: 95024
  derived and/or modified sequence opt2 from hemagglutinin__InfluenzaA__ADO33261

SEQ ID NO: 97684 - RNA, 1701 nt, Artificial Sequence; identical to SEQ ID NO: 95024
  derived and/or modified sequence opt2 from hemagglutinin__InfluenzaA__ADO33269

SEQ ID NO: 97685 - RNA, 1701 nt, Artificial Sequence; identical to SEQ ID NO: 95516
  derived and/or modified sequence opt2 from hemagglutinin__InfluenzaA__ADO33277

SEQ ID NO: 97686 - RNA, 1701 nt, Artificial Sequence; identical to SEQ ID NO: 95024
  derived and/or modified sequence opt2 from hemagglutinin__InfluenzaA__ADO33285

SEQ ID NO: 97687 - RNA, 1701 nt, Artificial Sequence; identical to SEQ ID NO: 95516
  derived and/or modified sequence opt2 from hemagglutinin__InfluenzaA__ADO33293

SEQ ID NO: 97688 - RNA, 1701 nt, Artificial Sequence; identical to SEQ ID NO: 95516
  derived and/or modified sequence opt2 from hemagglutinin__InfluenzaA__ADO33307

SEQ ID NO: 97689 - RNA, 1701 nt, Artificial Sequence; identical to SEQ ID NO: 95024
  derived and/or modified sequence opt2 from hemagglutinin__InfluenzaA__ADO33313

SEQ ID NO: 97690 - RNA, 1701 nt, Artificial Sequence; identical to SEQ ID NO: 97274
  derived and/or modified sequence opt2 from hemagglutinin__InfluenzaA__ADO33329

SEQ ID NO: 97691 - RNA, 1701 nt, Artificial Sequence; identical to SEQ ID NO: 95024
  derived and/or modified sequence opt2 from hemagglutinin__InfluenzaA__ADO33337

SEQ ID NO: 97692 - RNA, 1701 nt, Artificial Sequence; identical to SEQ ID NO: 95024
  derived and/or modified sequence opt2 from hemagglutinin__InfluenzaA__ADO33345

SEQ ID NO: 97693 - RNA, 1701 nt, Artificial Sequence; identical to SEQ ID NO: 95516
  derived and/or modified sequence opt2 from hemagglutinin__InfluenzaA__ADO33352

SEQ ID NO: 97694 - RNA, 1701 nt, Artificial Sequence; identical to SEQ ID NO: 94181
  derived and/or modified sequence opt2 from hemagglutinin__InfluenzaA__ADO33360

SEQ ID NO: 97695 - RNA, 1701 nt, Artificial Sequence; identical to SEQ ID NO: 95024
  derived and/or modified sequence opt2 from hemagglutinin__InfluenzaA__ADO33368

SEQ ID NO: 97696 - RNA, 1701 nt, Artificial Sequence; identical to SEQ ID NO: 95024
  derived and/or modified sequence opt2 from hemagglutinin__InfluenzaA__ADO33376

SEQ ID NO: 97697 - RNA, 1701 nt, Artificial Sequence; identical to SEQ ID NO: 94168
  derived and/or modified sequence opt2 from hemagglutinin__InfluenzaA__ADO33384

SEQ ID NO: 97698 - RNA, 1701 nt, Artificial Sequence; identical to SEQ ID NO: 94181
  derived and/or modified sequence opt2 from hemagglutinin__InfluenzaA__ADO33391

SEQ ID NO: 97699 - RNA, 1701 nt, Artificial Sequence
  derived and/or modified sequence opt2 from hemagglutinin__InfluenzaA__ADO79917
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97700 - RNA, 1701 nt, Artificial Sequence
  derived and/or modified sequence opt2 from hemagglutinin__InfluenzaA__ADO79923
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagcgccgcaugaacuacuacuggacccucguccagcccggcgacaagaucaccuuccaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97701 - RNA, 1701 nt, Artificial Sequence
  derived and/or modified sequence opt2 from hemagglutinin__InfluenzaA__ADO79924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucaucgagcccggcgacaagaucaccuucgagcccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97702 - RNA, 1701 nt, Artificial Sequence
  derived and/or modified sequence opt2 from hemagglutinin__InfluenzaA__ADO79925
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccacccacgaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggcccccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaagaucggcaagugcuccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97703 - RNA, 1701 nt, Artificial Sequence
  derived and/or modified sequence opt2 from hemagglutinin__InfluenzaA__ADO79926
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuucuccaagcucuccaagaccuaccucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgucggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaugaagaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97704 - RNA, 1701 nt, Artificial Sequence
  derived and/or modified sequence opt2 from hemagglutinin__InfluenzaA__ADO79927
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgccgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccguccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaugaagaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97705 - RNA, 1701 nt, Artificial Sequence
  derived and/or modified sequence opt2 from hemagglutinin__InfluenzaA__ADO79928
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97706 - RNA, 1701 nt, Artificial Sequence
  derived and/or modified sequence opt2 from hemagglutinin__InfluenzaA__ADO79929
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97707 - RNA, 1701 nt, Artificial Sequence
  derived and/or modified sequence opt2 from hemagglutinin__InfluenzaA__ADO79930
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccaccgacaaguggaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97708 - RNA, 1701 nt, Artificial Sequence
  derived and/or modified sequence opt2 from hemagglutinin__InfluenzaA__ADO84715
augaaggccauccucgucguccuccucuacaccuucgccaccgccaacgccggcacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuucuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97709 - RNA, 1701 nt, Artificial Sequence; identical to SEQ ID NO: 94361
  derived and/or modified sequence opt2 from hemagglutinin__InfluenzaA__ADP95341

SEQ ID NO: 97710 - RNA, 1701 nt, Artificial Sequence; identical to SEQ ID NO: 94168
  derived and/or modified sequence opt2 from hemagglutinin__InfluenzaA__ADP95351

SEQ ID NO: 97711 - RNA, 1701 nt, Artificial Sequence; identical to SEQ ID NO: 94168
  derived and/or modified sequence opt2 from hemagglutinin__InfluenzaA__ADP95361

SEQ ID NO: 97712 - RNA, 1701 nt, Artificial Sequence; identical to SEQ ID NO: 94168
  derived and/or modified sequence opt2 from hemagglutinin__InfluenzaA__ADP95371

SEQ ID NO: 97713 - RNA, 1701 nt, Artificial Sequence; identical to SEQ ID NO: 94168
  derived and/or modified sequence opt2 from hemagglutinin__InfluenzaA__ADP95381

SEQ ID NO: 97714 - RNA, 1701 nt, Artificial Sequence; identical to SEQ ID NO: 94168
  derived and/or modified sequence opt2 from hemagglutinin__InfluenzaA__ADP95391

SEQ ID NO: 97715 - RNA, 1701 nt, Artificial Sequence; identical to SEQ ID NO: 94423
  derived and/or modified sequence opt2 from hemagglutinin__InfluenzaA__ADQ28007

SEQ ID NO: 97716 - RNA, 1701 nt, Artificial Sequence; identical to SEQ ID NO: 94181
  derived and/or modified sequence opt2 from hemagglutinin__InfluenzaA__ADQ28008

SEQ ID NO: 97717 - RNA, 1701 nt, Artificial Sequence; identical to SEQ ID NO: 96032
  derived and/or modified sequence opt2 from hemagglutinin__InfluenzaA__ADQ28009

SEQ ID NO: 97718 - RNA, 1701 nt, Artificial Sequence
  derived and/or modified sequence opt2 from hemagglutinin__InfluenzaA__ADQ28010
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagucccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97719 - RNA, 1701 nt, Artificial Sequence; identical to SEQ ID NO: 94181
  derived and/or modified sequence opt2 from hemagglutinin__InfluenzaA__ADQ28011

SEQ ID NO: 97720 - RNA, 1701 nt, Artificial Sequence; identical to SEQ ID NO: 94181
  derived and/or modified sequence opt2 from hemagglutinin__InfluenzaA__ADQ28012

SEQ ID NO: 97721 - RNA, 1701 nt, Artificial Sequence; identical to SEQ ID NO: 94181
  derived and/or modified sequence opt2 from hemagglutinin__InfluenzaA__ADQ28013

SEQ ID NO: 97722 - RNA, 1701 nt, Artificial Sequence; identical to SEQ ID NO: 94423
  derived and/or modified sequence opt2 from hemagglutinin__InfluenzaA__ADQ28014

SEQ ID NO: 97723 - RNA, 1701 nt, Artificial Sequence; identical to SEQ ID NO: 94423
  derived and/or modified sequence opt2 from hemagglutinin__InfluenzaA__ADQ28015

SEQ ID NO: 97724 - RNA, 1701 nt, Artificial Sequence; identical to SEQ ID NO: 94181
  derived and/or modified sequence opt2 from hemagglutinin__InfluenzaA__ADQ28016

SEQ ID NO: 97725 - RNA, 1701 nt, Artificial Sequence; identical to SEQ ID NO: 94181
  derived and/or modified sequence opt2 from hemagglutinin__InfluenzaA__ADQ28017

SEQ ID NO: 97726 - RNA, 1701 nt, Artificial Sequence; identical to SEQ ID NO: 96427
  derived and/or modified sequence opt2 from hemagglutinin__InfluenzaA__ADQ28018

SEQ ID NO: 97727 - RNA, 1701 nt, Artificial Sequence; identical to SEQ ID NO: 94423
  derived and/or modified sequence opt2 from hemagglutinin__InfluenzaA__ADQ28019

SEQ ID NO: 97728 - RNA, 1701 nt, Artificial Sequence
  derived and/or modified sequence opt2 from hemagglutinin__InfluenzaA__ADQ28020
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97729 - RNA, 1701 nt, Artificial Sequence; identical to SEQ ID NO: 95375
  derived and/or modified sequence opt2 from hemagglutinin__InfluenzaA__ADQ28021

SEQ ID NO: 97730 - RNA, 1701 nt, Artificial Sequence
  derived and/or modified sequence opt2 from hemagglutinin__InfluenzaA__ADQ28022
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97731 - RNA, 1701 nt, Artificial Sequence; identical to SEQ ID NO: 94181
  derived and/or modified sequence opt2 from hemagglutinin__InfluenzaA__ADQ28023

SEQ ID NO: 97732 - RNA, 1701 nt, Artificial Sequence; identical to SEQ ID NO: 94423
  derived and/or modified sequence opt2 from hemagglutinin__InfluenzaA__ADQ28024

SEQ ID NO: 97733 - RNA, 1701 nt, Artificial Sequence; identical to SEQ ID NO: 94423
  derived and/or modified sequence opt2 from hemagglutinin__InfluenzaA__ADQ28025

SEQ ID NO: 97734 - RNA, 1701 nt, Artificial Sequence; identical to SEQ ID NO: 94926
  derived and/or modified sequence opt2 from hemagglutinin__InfluenzaA__ADQ28028

SEQ ID NO: 97735 - RNA, 1701 nt, Artificial Sequence; identical to SEQ ID NO: 96406
  derived and/or modified sequence opt2 from hemagglutinin__InfluenzaA__ADQ28029

SEQ ID NO: 97736 - RNA, 1701 nt, Artificial Sequence
  derived and/or modified sequence opt2 from hemagglutinin__InfluenzaA__ADQ28030
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97737 - RNA, 1701 nt, Artificial Sequence; identical to SEQ ID NO: 95375
  derived and/or modified sequence opt2 from hemagglutinin__InfluenzaA__ADQ28031

SEQ ID NO: 97738 - RNA, 1701 nt, Artificial Sequence; identical to SEQ ID NO: 94423
  derived and/or modified sequence opt2 from hemagglutinin__InfluenzaA__ADQ28032

SEQ ID NO: 97739 - RNA, 1701 nt, Artificial Sequence
  derived and/or modified sequence opt2 from hemagglutinin__InfluenzaA__ADQ28034
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggaccaucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaaccgcaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97740 - RNA, 1701 nt, Artificial Sequence
  derived and/or modified sequence opt2 from hemagglutinin__InfluenzaA__ADQ28035
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccgccuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97741 - RNA, 1701 nt, Artificial Sequence; identical to SEQ ID NO: 94181
  derived and/or modified sequence opt2 from hemagglutinin__InfluenzaA__ADQ28036

SEQ ID NO: 97742 - RNA, 1701 nt, Artificial Sequence; identical to SEQ ID NO: 94181
  derived and/or modified sequence opt2 from hemagglutinin__InfluenzaA__ADQ28037

SEQ ID NO: 97743 - RNA, 1701 nt, Artificial Sequence; identical to SEQ ID NO: 94423
  derived and/or modified sequence opt2 from hemagglutinin__InfluenzaA__ADQ28038

SEQ ID NO: 97744 - RNA, 1701 nt, Artificial Sequence; identical to SEQ ID NO: 94181
  derived and/or modified sequence opt2 from hemagglutinin__InfluenzaA__ADQ28039

SEQ ID NO: 97745 - RNA, 1701 nt, Artificial Sequence; identical to SEQ ID NO: 94423
  derived and/or modified sequence opt2 from hemagglutinin__InfluenzaA__ADQ28040

SEQ ID NO: 97746 - RNA, 1701 nt, Artificial Sequence; identical to SEQ ID NO: 94423
  derived and/or modified sequence opt2 from hemagglutinin__InfluenzaA__ADQ28041

SEQ ID NO: 97747 - RNA, 1701 nt, Artificial Sequence
  derived and/or modified sequence opt2 from hemagglutinin__InfluenzaA__ADQ28043
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgacggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97748 - RNA, 1701 nt, Artificial Sequence; identical to SEQ ID NO: 94423
  derived and/or modified sequence opt2 from hemagglutinin__InfluenzaA__ADQ28044

SEQ ID NO: 97749 - RNA, 1701 nt, Artificial Sequence
  derived and/or modified sequence opt2 from hemagglutinin__InfluenzaA__ADQ28045
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97750 - RNA, 1701 nt, Artificial Sequence; identical to SEQ ID NO: 94651
  derived and/or modified sequence opt2 from hemagglutinin__InfluenzaA__ADQ28047

SEQ ID NO: 97751 - RNA, 1701 nt, Artificial Sequence; identical to SEQ ID NO: 94181
  derived and/or modified sequence opt2 from hemagglutinin__InfluenzaA__ADQ28048

SEQ ID NO: 97752 - RNA, 1701 nt, Artificial Sequence; identical to SEQ ID NO: 94423
  derived and/or modified sequence opt2 from hemagglutinin__InfluenzaA__ADQ28049

SEQ ID NO: 97753 - RNA, 1701 nt, Artificial Sequence; identical to SEQ ID NO: 94181
  derived and/or modified sequence opt2 from hemagglutinin__InfluenzaA__ADQ28050

SEQ ID NO: 97754 - RNA, 1701 nt, Artificial Sequence
  derived and/or modified sequence opt2 from hemagglutinin__InfluenzaA__ADQ28051
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97755 - RNA, 1701 nt, Artificial Sequence; identical to SEQ ID NO: 94181
  derived and/or modified sequence opt2 from hemagglutinin__InfluenzaA__ADQ28053

SEQ ID NO: 97756 - RNA, 1701 nt, Artificial Sequence; identical to SEQ ID NO: 94423
  derived and/or modified sequence opt2 from hemagglutinin__InfluenzaA__ADQ28055

SEQ ID NO: 97757 - RNA, 1701 nt, Artificial Sequence
  derived and/or modified sequence opt2 from hemagglutinin__InfluenzaA__ADQ28056
auggaggccauccucgucguccuccucuacaccuucgccaccgccgacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97758 - RNA, 1701 nt, Artificial Sequence; identical to SEQ ID NO: 94181
  derived and/or modified sequence opt2 from hemagglutinin__InfluenzaA__ADQ28057

SEQ ID NO: 97759 - RNA, 1701 nt, Artificial Sequence; identical to SEQ ID NO: 94181
  derived and/or modified sequence opt2 from hemagglutinin__InfluenzaA__ADQ28058

SEQ ID NO: 97760 - RNA, 1701 nt, Artificial Sequence
  derived and/or modified sequence opt2 from hemagglutinin__InfluenzaA__ADQ28059
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97761 - RNA, 1701 nt, Artificial Sequence; identical to SEQ ID NO: 94181
  derived and/or modified sequence opt2 from hemagglutinin__InfluenzaA__ADQ28060

SEQ ID NO: 97762 - RNA, 1701 nt, Artificial Sequence
  derived and/or modified sequence opt2 from hemagglutinin__InfluenzaA__ADQ28061
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggccgcugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccaacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97763 - RNA, 1701 nt, Artificial Sequence
  derived and/or modified sequence opt2 from hemagglutinin__InfluenzaA__ADQ28063
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuaccacuggacccucgucaagcccggcgacaagaucaccuucgaggccaccggcaaccucgucgucccccgcuacgccuucgccgucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97764 - RNA, 1701 nt, Artificial Sequence; identical to SEQ ID NO: 94929
  derived and/or modified sequence opt2 from hemagglutinin__InfluenzaA__ADQ28064

SEQ ID NO: 97765 - RNA, 1701 nt, Artificial Sequence
  derived and/or modified sequence opt2 from hemagglutinin__InfluenzaA__ADQ28065
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccggccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccagguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97766 - RNA, 1701 nt, Artificial Sequence
  derived and/or modified sequence opt2 from hemagglutinin__InfluenzaA__ADQ28066
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgcccccgcguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97767 - RNA, 1701 nt, Artificial Sequence
  derived and/or modified sequence opt2 from hemagglutinin__InfluenzaA__ADQ28067
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97768 - RNA, 1701 nt, Artificial Sequence
  derived and/or modified sequence opt2 from hemagglutinin__InfluenzaA__ADQ28068
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97769 - RNA, 1701 nt, Artificial Sequence; identical to SEQ ID NO: 97767
  derived and/or modified sequence opt2 from hemagglutinin__InfluenzaA__ADQ28069

SEQ ID NO: 97770 - RNA, 1701 nt, Artificial Sequence
  derived and/or modified sequence opt2 from hemagglutinin__InfluenzaA__ADQ28070
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgccgccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97771 - RNA, 1701 nt, Artificial Sequence
  derived and/or modified sequence opt2 from hemagglutinin__InfluenzaA__ADQ28071
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97772 - RNA, 1701 nt, Artificial Sequence; identical to SEQ ID NO: 95125
  derived and/or modified sequence opt2 from hemagglutinin__InfluenzaA__ADR32361

SEQ ID NO: 97773 - RNA, 1689 nt, Artificial Sequence
  derived and/or modified sequence opt2 from hemagglutinin__InfluenzaA__ADT78887
auggcccucaucuaccucauccuccucuucaccuccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaaccccaaguacucccucugcuaccccggcuccuucaacgacuacgaggagcucaagcaccucaucuccuccgucaagcacuucgagaaggucaagauccuccccaaggacggcuggacccagcacaccaccaccggcggcucccgcgccugcgccgucuccggcaaccccuccuucuuccgcaacauggucuggcucaccaagaagggccccaacuaccccgucgccaagggcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccacccccgagaucgccgcccgccccgaggucaacggccucggcucccgcauggaguucuccuggacccuccucgacaugugggacaccaucaacuucgaguccaccggcaaccucgucgcccccgaguacggcuucaagaucuccaagcgcggcuccuccggcgucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 97774 - RNA, 1701 nt, Artificial Sequence
  derived and/or modified sequence opt2 from hemagglutinin__InfluenzaA__ADT78908
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaaggccccccuccagcucggcaagugcaacaucgccggcuggguccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaccacccgcggcgucaccgccgccugcucccacgcccgcaaguccuccuucuacaagaaccucgucuggcucaccgaggccaacggcuccuaccccaaccucuccaaguccuacgucaacaaccaggagaaggagguccucguccucuggggcguccaccaccccuccaacaucgaggaccagcgcacccucuaccgcaaggacaacgccuacgucuccgucgucuccuccaacuacaaccgccgcuucacccccgagaucgccaagcgccccaagguccgcgaccagcccggccgcaugaacuacuacuggacccuccucgagcccggcgacaccaucaucuucgaggccaccggcaaccucaucgcccccugguacgccuucgcccucucccgcggccccggcuccggcaucaucaccuccaacgcccccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagcucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97775 - RNA, 1701 nt, Artificial Sequence
  derived and/or modified sequence opt2 from hemagglutinin__InfluenzaA__ADT78929
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccggcaaguccuccuucuacaagaaccuccucuggcucaccgagaccaagggcuccuaccccaaccucuccaaguccuacgucaacaacaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaccaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccgucaccaucggcgagugccccaaguacgucaaguccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97776 - RNA, 1701 nt, Artificial Sequence
  derived and/or modified sequence opt2 from hemagglutinin__InfluenzaA__ADT78936
augaaggccaagcuccucguccuccucugcgcccucuccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaaggccccccuccagcucggcaagugcaacaucgccggcuggauccucggcaaccccgagugcgagucccuccucuccaagcgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggaguccuccuggcccaagcacaacaccacccgcggcgucaccgccgccugcucccacgcccgcaaguccuccuucuacaagaaccuccucuggcucaccgaggccaacggcuccuaccccaaccucuccaaguccuacgucaacaaccaggagaaggagguccucguccucuggggcguccaccaccccuccaacaucgaggaccagcgcacccucuaccgcaaggagaacgccuacgucuccgucgucuccuccaacuacaaccgccgcuucacccccgagaucgccgagcgccccaagguccgcaaccaggccggccgcaugaacuacuacuggacccuccucgagcccggcgacaccaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccgucaccaucggcgagugccccaaguacgucaaguccaccaagcuccgcauggucaccggccuccgcaacauccccuccauccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagcucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97777 - RNA, 1689 nt, Artificial Sequence
  derived and/or modified sequence opt2 from hemagglutinin__InfluenzaA__ADT78961
auggccaucaucugccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaagaaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucgagaccuacgucuccgucuccaccuccacccucaacaagcgcuccacccccaagaucgccacccgccccgaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggcccccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgucaucuacgccaccgucgccggcucccucucccucgccaucaugauggccggcaucuccuucuggaugugcuccaacggcucccuccagugccgcaucugcaucuga

SEQ ID NO: 97778 - RNA, 1701 nt, Artificial Sequence; identical to SEQ ID NO: 92276
  derived and/or modified sequence opt2 from hemagglutinin__InfluenzaA__ADT78971

SEQ ID NO: 97779 - RNA, 1701 nt, Artificial Sequence; identical to SEQ ID NO: 91817
  derived and/or modified sequence opt2 from hemagglutinin__InfluenzaA__ADT79010

SEQ ID NO: 97780 - RNA, 1701 nt, Artificial Sequence; identical to SEQ ID NO: 92276
  derived and/or modified sequence opt2 from hemagglutinin__InfluenzaA__ADT79030

SEQ ID NO: 97781 - RNA, 1701 nt, Artificial Sequence; identical to SEQ ID NO: 92854
  derived and/or modified sequence opt2 from hemagglutinin__InfluenzaA__ADT79050

SEQ ID NO: 97782 - RNA, 1701 nt, Artificial Sequence
  derived and/or modified sequence opt2 from hemagglutinin__InfluenzaA__ADT79108
augaaggcccgccuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccaagaaguccuccuucuacaagaaccuccucuggcucaccgaggccaacggcuccuaccccaaccucaucaaguccuacgucaacaacaaggagaaggagguccucguccucuggggcguccaccaccccuccaacaucgaggaccagcgcacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaagaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97783 - RNA, 1689 nt, Artificial Sequence
  derived and/or modified sequence opt2 from hemagglutinin__InfluenzaA__ADT79119
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 97784 - RNA, 1689 nt, Artificial Sequence
  derived and/or modified sequence opt2 from hemagglutinin__InfluenzaA__ADT79129
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacaugaucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucgucaccuccacccucaacaagcgcuccacccccaagaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucgccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagcgcgccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 97785 - RNA, 1701 nt, Artificial Sequence
  derived and/or modified sequence opt2 from hemagglutinin__InfluenzaA__ADT79232
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacaagcaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgacgucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97786 - RNA, 1701 nt, Artificial Sequence
  derived and/or modified sequence opt2 from hemagglutinin__InfluenzaA__ADT79242
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97787 - RNA, 1701 nt, Artificial Sequence
  derived and/or modified sequence opt2 from hemagglutinin__InfluenzaA__ADT91182
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagccccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97788 - RNA, 1701 nt, Artificial Sequence
  derived and/or modified sequence opt2 from hemagglutinin__InfluenzaA__ADU20561
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97789 - RNA, 1701 nt, Artificial Sequence
  derived and/or modified sequence opt2 from hemagglutinin__InfluenzaA__ADU20562
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaagaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97790 - RNA, 1701 nt, Artificial Sequence
  derived and/or modified sequence opt2 from hemagglutinin__InfluenzaA__ADU25478
auggaggccaagcucuucguccucuucugcgccuucaccgcccucaaggccgacaccaucugcgucggcuaccacgccaacaacuccaccgacaccgucgacaccauccucgagcgcaacgucaccgucacccacuccgucaaccuccucgaguccucccacaacggcaagcucugcucccucaacggcaaggccccccuccagcucggcaacugcaacgucgccggcuggauccucggcaaccccgagugcgaccuccuccucaccgucaacuccugguccuacaucaucgagaccuccaccuccaagaacggcgccugcuaccccggcgaguucgccgacuacgaggagcuccgcgagcagcucuccaccgucuccuccuucgagcgcuucgagaucuuccccaaggccaccuccuggcccaaccacgagaccaccaagggcaccaccgucgccugcucccacuccggcgccaacuccuucuaccgcaaccuccucuggaucgucaagaagggcaacuccuaccccaagcucuccaaguccuacaccaacaacaagggcaaggagguccucgucaucuggggcguccaccacccccccaccgacuccgaccagcagacccucuaccagaacaaccacaccuacgucuccgucggcuccuccaaguacuaccagcgcuucacccccgagaucgucacccgccccaagguccgcgagcaggccggccgcaugaacuacuacuggacccuccucgaccagggcgacaccaucaccuucgaggccaccggcaaccucaucgcccccuggcacgccuucgcccucaacaagggcuccuccuccggcaucaugauguccgacgcccacguccacaacugcaccaccaagugccagaccccccacggcgcccucaaguccaaccuccccuuccagaacguccaccccaucaccaucggcgagugccccaaguacgucaaguccacccagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaucgccaucgacggcaucuccaacaaggucaacuccgucaucgagaagaugaacguccaguucaccuccgucggcaaggaguucaacaaccucgagaagcgcaucgagaaccucaacaagaaggucgacgacggcuuccucgacaucuggaccuacaacgccgagcuccucauccuccucgagaacgagcgcacccucgacuuccacgacuucaacgucaagaaccucuacgagcgcgucaagucccagcuccgcaacaacgccaaggagaucggcaacggcugcuucgaguucuaccacaagugcaacaacgagugcauggaguccgucaagaacggcaccuacaacuacccccgcuacuccgaggaguccaagcucaaccgcgaggagaucgacggcgucaagcucgaguccgucggcguccaccagauccucgccaucuacuccaccgucgccuccucccucguccuccucgucucccucggcgccaucuccuucuggaugugcuccaacggcucccuccagugccgcaucugcaucuga

SEQ ID NO: 97791 - RNA, 1701 nt, Artificial Sequence
  derived and/or modified sequence opt2 from hemagglutinin__InfluenzaA__ADU59558
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97792 - RNA, 1701 nt, Artificial Sequence; identical to SEQ ID NO: 94181
  derived and/or modified sequence opt2 from hemagglutinin__InfluenzaA__ADU59579

SEQ ID NO: 97793 - RNA, 1701 nt, Artificial Sequence; identical to SEQ ID NO: 94181
  derived and/or modified sequence opt2 from hemagglutinin__InfluenzaA__ADU59590

SEQ ID NO: 97794 - RNA, 1701 nt, Artificial Sequence; identical to SEQ ID NO: 94181
  derived and/or modified sequence opt2 from hemagglutinin__InfluenzaA__ADU59601

SEQ ID NO: 97795 - RNA, 1701 nt, Artificial Sequence; identical to SEQ ID NO: 94181
  derived and/or modified sequence opt2 from hemagglutinin__InfluenzaA__ADU59612

SEQ ID NO: 97796 - RNA, 1701 nt, Artificial Sequence; identical to SEQ ID NO: 94181
  derived and/or modified sequence opt2 from hemagglutinin__InfluenzaA__ADU59768

SEQ ID NO: 97797 - RNA, 1701 nt, Artificial Sequence; identical to SEQ ID NO: 94181
  derived and/or modified sequence opt2 from hemagglutinin__InfluenzaA__ADU59769

SEQ ID NO: 97798 - RNA, 1701 nt, Artificial Sequence; identical to SEQ ID NO: 94181
  derived and/or modified sequence opt2 from hemagglutinin__InfluenzaA__ADU59771

SEQ ID NO: 97799 - RNA, 1701 nt, Artificial Sequence; identical to SEQ ID NO: 94181
  derived and/or modified sequence opt2 from hemagglutinin__InfluenzaA__ADU59772

SEQ ID NO: 97800 - RNA, 1701 nt, Artificial Sequence; identical to SEQ ID NO: 94181
  derived and/or modified sequence opt2 from hemagglutinin__InfluenzaA__ADU59774

SEQ ID NO: 97801 - RNA, 1701 nt, Artificial Sequence; identical to SEQ ID NO: 94181
  derived and/or modified sequence opt2 from hemagglutinin__InfluenzaA__ADU59906

SEQ ID NO: 97802 - RNA, 1701 nt, Artificial Sequence; identical to SEQ ID NO: 94181
  derived and/or modified sequence opt2 from hemagglutinin__InfluenzaA__ADU59916

SEQ ID NO: 97803 - RNA, 1701 nt, Artificial Sequence; identical to SEQ ID NO: 94181
  derived and/or modified sequence opt2 from hemagglutinin__InfluenzaA__ADU76756

SEQ ID NO: 97804 - RNA, 1701 nt, Artificial Sequence; identical to SEQ ID NO: 94181
  derived and/or modified sequence opt2 from hemagglutinin__InfluenzaA__ADU76757

SEQ ID NO: 97805 - RNA, 1701 nt, Artificial Sequence; identical to SEQ ID NO: 94181
  derived and/or modified sequence opt2 from hemagglutinin__InfluenzaA__ADU76758

SEQ ID NO: 97806 - RNA, 1701 nt, Artificial Sequence; identical to SEQ ID NO: 94181
  derived and/or modified sequence opt2 from hemagglutinin__InfluenzaA__ADU76759

SEQ ID NO: 97807 - RNA, 1701 nt, Artificial Sequence; identical to SEQ ID NO: 94541
  derived and/or modified sequence opt2 from hemagglutinin__InfluenzaA__ADU76761

SEQ ID NO: 97808 - RNA, 1701 nt, Artificial Sequence; identical to SEQ ID NO: 94181
  derived and/or modified sequence opt2 from hemagglutinin__InfluenzaA__ADU76762

SEQ ID NO: 97809 - RNA, 1701 nt, Artificial Sequence
  derived and/or modified sequence opt2 from hemagglutinin__InfluenzaA__ADU76764
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgaggccuccuccuccaacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaucgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97810 - RNA, 1701 nt, Artificial Sequence
  derived and/or modified sequence opt2 from hemagglutinin__InfluenzaA__ADU76765
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccuccgucgccuccucccucguccucgucgucucccucggcgccaucuccuucuggaugugcuccaacggcucccuccagugccgcaucugcaucuga

SEQ ID NO: 97811 - RNA, 1701 nt, Artificial Sequence; identical to SEQ ID NO: 95778
  derived and/or modified sequence opt2 from hemagglutinin__InfluenzaA__ADU76766

SEQ ID NO: 97812 - RNA, 1701 nt, Artificial Sequence
  derived and/or modified sequence opt2 from hemagglutinin__InfluenzaA__ADU76767
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97813 - RNA, 1701 nt, Artificial Sequence
  derived and/or modified sequence opt2 from hemagglutinin__InfluenzaA__ADU76768
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97814 - RNA, 1701 nt, Artificial Sequence; identical to SEQ ID NO: 94181
  derived and/or modified sequence opt2 from hemagglutinin__InfluenzaA__ADU76769

SEQ ID NO: 97815 - RNA, 1701 nt, Artificial Sequence; identical to SEQ ID NO: 94181
  derived and/or modified sequence opt2 from hemagglutinin__InfluenzaA__ADU76770

SEQ ID NO: 97816 - RNA, 1701 nt, Artificial Sequence; identical to SEQ ID NO: 94181
  derived and/or modified sequence opt2 from hemagglutinin__InfluenzaA__ADU76771

SEQ ID NO: 97817 - RNA, 1701 nt, Artificial Sequence; identical to SEQ ID NO: 94926
  derived and/or modified sequence opt2 from hemagglutinin__InfluenzaA__ADU76772

SEQ ID NO: 97818 - RNA, 1701 nt, Artificial Sequence; identical to SEQ ID NO: 94181
  derived and/or modified sequence opt2 from hemagglutinin__InfluenzaA__ADU76774

SEQ ID NO: 97819 - RNA, 1701 nt, Artificial Sequence; identical to SEQ ID NO: 94181
  derived and/or modified sequence opt2 from hemagglutinin__InfluenzaA__ADU76775

SEQ ID NO: 97820 - RNA, 1701 nt, Artificial Sequence; identical to SEQ ID NO: 94181
  derived and/or modified sequence opt2 from hemagglutinin__InfluenzaA__ADU76776

SEQ ID NO: 97821 - RNA, 1701 nt, Artificial Sequence; identical to SEQ ID NO: 94181
  derived and/or modified sequence opt2 from hemagglutinin__InfluenzaA__ADU76777

SEQ ID NO: 97822 - RNA, 1701 nt, Artificial Sequence; identical to SEQ ID NO: 94181
  derived and/or modified sequence opt2 from hemagglutinin__InfluenzaA__ADU76778

SEQ ID NO: 97823 - RNA, 1701 nt, Artificial Sequence; identical to SEQ ID NO: 97039
  derived and/or modified sequence opt2 from hemagglutinin__InfluenzaA__ADU76779

SEQ ID NO: 97824 - RNA, 1701 nt, Artificial Sequence; identical to SEQ ID NO: 94181
  derived and/or modified sequence opt2 from hemagglutinin__InfluenzaA__ADU76780

SEQ ID NO: 97825 - RNA, 1701 nt, Artificial Sequence; identical to SEQ ID NO: 95778
  derived and/or modified sequence opt2 from hemagglutinin__InfluenzaA__ADU76781

SEQ ID NO: 97826 - RNA, 1701 nt, Artificial Sequence; identical to SEQ ID NO: 94541
  derived and/or modified sequence opt2 from hemagglutinin__InfluenzaA__ADU76782

SEQ ID NO: 97827 - RNA, 1701 nt, Artificial Sequence
  derived and/or modified sequence opt2 from hemagglutinin__InfluenzaA__ADU76784
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccaacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97828 - RNA, 1701 nt, Artificial Sequence; identical to SEQ ID NO: 94181
  derived and/or modified sequence opt2 from hemagglutinin__InfluenzaA__ADU76785

SEQ ID NO: 97829 - RNA, 1701 nt, Artificial Sequence; identical to SEQ ID NO: 94181
  derived and/or modified sequence opt2 from hemagglutinin__InfluenzaA__ADU76786

SEQ ID NO: 97830 - RNA, 1701 nt, Artificial Sequence
  derived and/or modified sequence opt2 from hemagglutinin__InfluenzaA__ADU76787
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97831 - RNA, 1701 nt, Artificial Sequence; identical to SEQ ID NO: 97812
  derived and/or modified sequence opt2 from hemagglutinin__InfluenzaA__ADU76788

SEQ ID NO: 97832 - RNA, 1701 nt, Artificial Sequence; identical to SEQ ID NO: 97812
  derived and/or modified sequence opt2 from hemagglutinin__InfluenzaA__ADU76789

SEQ ID NO: 97833 - RNA, 1701 nt, Artificial Sequence; identical to SEQ ID NO: 94181
  derived and/or modified sequence opt2 from hemagglutinin__InfluenzaA__ADU76790

SEQ ID NO: 97834 - RNA, 1701 nt, Artificial Sequence; identical to SEQ ID NO: 94181
  derived and/or modified sequence opt2 from hemagglutinin__InfluenzaA__ADU76791

SEQ ID NO: 97835 - RNA, 1701 nt, Artificial Sequence; identical to SEQ ID NO: 97812
  derived and/or modified sequence opt2 from hemagglutinin__InfluenzaA__ADU76792

SEQ ID NO: 97836 - RNA, 1701 nt, Artificial Sequence
  derived and/or modified sequence opt2 from hemagglutinin__InfluenzaA__ADU76793
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcaccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97837 - RNA, 1701 nt, Artificial Sequence
  derived and/or modified sequence opt2 from hemagglutinin__InfluenzaA__ADU85911
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaaccuccucgagaacaagcacaacggcaagcucugcaagcucggcggcaucgccccccuccaccucggcaagugcgacaucgccggcuggcuccucggcaaccccgagugcgagucccucuucaccgccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggccaacuccuggcccaaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucaagcccgagaucgccgcccgccccaagguccgcgaccaggccggccgcauggacuacuacuggacccucaucgagcccggcgacaccaucaccuucgaggccaccggcaaccucgucgucccccgcuacgccuucgccaugaagcgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuuccucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucucccagcucgagaagcgcaucgagucccucaacaacaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 97838 - RNA, 1701 nt, Artificial Sequence; identical to SEQ ID NO: 95345
  derived and/or modified sequence opt2 from hemagglutinin__InfluenzaA__ADV17283

SEQ ID NO: 97839 - RNA, 1701 nt, Artificial Sequence; identical to SEQ ID NO: 95345
  derived and/or modified sequence opt2 from hemagglutinin__InfluenzaA__ADV17293

SEQ ID NO: 97840 - RNA, 1701 nt, Artificial Sequence
  derived and/or modified sequence opt2 from hemagglutinin__InfluenzaA__ADV17303
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaagggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97841 - RNA, 1701 nt, Artificial Sequence; identical to SEQ ID NO: 95345
  derived and/or modified sequence opt2 from hemagglutinin__InfluenzaA__ADV17313

SEQ ID NO: 97842 - RNA, 1701 nt, Artificial Sequence
  derived and/or modified sequence opt2 from hemagglutinin__InfluenzaA__ADV17323
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuacgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97843 - RNA, 1701 nt, Artificial Sequence
  derived and/or modified sequence opt2 from hemagglutinin__InfluenzaA__ADV17333
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagaaccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucguccuccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuacuacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgucaucuacuccaccgucgccuccucccucguccucgucgucucccucggcgccaucuccuucuggaugugcuccaacggcucccuccagugccgcaucugcaucuga

SEQ ID NO: 97844 - RNA, 1701 nt, Artificial Sequence; identical to SEQ ID NO: 94181
  derived and/or modified sequence opt2 from hemagglutinin__InfluenzaA__ADV19019

SEQ ID NO: 97845 - RNA, 1701 nt, Artificial Sequence; identical to SEQ ID NO: 94666
  derived and/or modified sequence opt2 from hemagglutinin__InfluenzaA__ADV41677

SEQ ID NO: 97846 - RNA, 1701 nt, Artificial Sequence
  derived and/or modified sequence opt2 from hemagglutinin__InfluenzaA__ADV58939
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacgagaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97847 - RNA, 1698 nt, Artificial Sequence
  derived and/or modified sequence opt2 from hemagglutinin__InfluenzaA__ADV69074
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccgaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccgccuccugcucccacaacggcaaguccuccuucuaccgcaaccuccucuggcucaccgucaagaacggccucuaccccaaccucuccaaguccuacaccaacgacaaggagaaggagguccucguccucuggggcguccaccacccccccuccaucggcgaccagcgcacccucuaccacaccgagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucugcgaggccaacggcaaccucaucgccccccgcuacgccuucgcccucucccgcggccucggcuccggcaucaucaccuccaacgcccccaugggcgagugcaacgccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucgcccucggcgccaucugcuucuggaugugcuccaacggcucccuccagugcaagaucugcaucuga

SEQ ID NO: 97848 - RNA, 1698 nt, Artificial Sequence
  derived and/or modified sequence opt2 from hemagglutinin__InfluenzaA__ADV69075
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccgaccccgagaacggcaccugcuaccccggcuacgucaccgacuacgaggagcuccgcgagcagcucuccuccgucuccuccuucaagcgcuucgagaucuuccccaaggaguccuccuggcccaaccacaccgucaccggcgucuccgccuccugcucccacaacggcaaguccuccuucuaccgcaaccuccucuggcucaccgucaagaacggccucuaccccaaccucuccaaguccuacaccaacgacaaggagaaggagguccucguccucuggggcguccaccacccccccuccaucggcgaccagcgcacccucuaccacaccgagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucugcgaggccaacggcaaccucaucgccccccgcuacgccuucgcccucucccgcggcuucggcuccggcaucaucaccuccaacgcccccaugggcgagugcaacgccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccccaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaaggucaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucgcccucggcgccaucugcuucuggaugugcuccaacggcucccuccagugcaagaucugcaucuga

SEQ ID NO: 97849 - RNA, 1698 nt, Artificial Sequence
  derived and/or modified sequence opt2 from hemagglutinin__InfluenzaA__ADV69077
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccgaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccgccuccugcucccacaacggcaaguccuccuucuaccgcaaccuccucuggcucaccgucaagaacggccucuaccccaaccucuccaaguccuacaccaacgacaaggagaaggagguccucguccucuggggcguccaccacccccccuccaucggcgaccagcgcacccucuaccacaccgagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccaugggcgagugcaacgccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucgcccucggcgccaucugcuucuggaugugcuccaacggcucccuccagugcaagaucugcaucuga

SEQ ID NO: 97850 - RNA, 1698 nt, Artificial Sequence
  derived and/or modified sequence opt2 from hemagglutinin__InfluenzaA__ADV69078
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccgccggcgucuccgccuccugcucccacaacggcgagaaguccuucuaccgcaaccucaucuggcucaccaagaagaacggccucuaccccaaccucuccaaguccuacgagaacgacaaggagaaggagguccucauccucuggggcguccaccacccccccaacaucgagaaccagcgcacccucuaccgcaccgagaacgccuacgucuccgucgucuccucccacuacuccggccgcuucacccccgagaucaccaagcgccccaagguccgcaaccaggagggccgcaucaacuacuacuggacccuccucgagcccggcgacaccaucaucuucgaggccaacggcaaccucaucgcccccugguacgccuucacccucucccgcggccucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccuccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97851 - RNA, 1698 nt, Artificial Sequence
  derived and/or modified sequence opt2 from hemagglutinin__InfluenzaA__ADV69079
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaagaaguccugguccuacaucgucaagacccccaaccccgagaacggcuccugcuaccccggcuacuucgccgacuacgaggagcuccgcgagcagcucuccuccgucuccuccuucgagcgcuucgagauguuccccaaggaguccuccuggcccaaccacaacgucaacggcgucuccgccuccugcucccacaacggcaagcgcuccuucuaccgcaaccuccucuggcucaccggcaagaacggccucuaccccaaccucaccaaguccuacgagaacaacaacgagaaggagguccucauccucuggggcguccaccaccccuccaacaucggcgaccagcgcacccucuaccacaccgagaacgccuacgucuccgucauguccucccacuacucccgccgcuucacccccgagaucaacaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccuccgcccccauggacgagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97852 - RNA, 1698 nt, Artificial Sequence
  derived and/or modified sequence opt2 from hemagglutinin__InfluenzaA__ADV69080
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccgccggcgucuccgccuccugcucccacaacggcgagcgcuccuucuaccgcaaccucaucuggcucaccaugaagaacggccucuaccccaaccuccgcaaguccuacgagaacgacaaggagaaggagguccucauccucuggggcguccaccacccccccaacaucgagaaccagcgcacccucuaccacaccgagaacgccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucucccgcggccucggcuccggcaucaucaccuccaacgcccccauggacgccugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcaucgagaaccucaacaagaaggucgacgacggcuucaucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97853 - RNA, 1698 nt, Artificial Sequence
  derived and/or modified sequence opt2 from hemagglutinin__InfluenzaA__ADV69081
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaagcucuccaaguccuacaccaacgacaaggagaaggagguccucguccucuggggcguccaccacccccccaacauccgcgaccagcgcacccucuaccacaccgagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccaugggcgagugcaacgccaagugccagaccccccagggcgccaucaucuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucgcccucggcgccaucugcuucuggaugugcuccaacggcucccuccagugcaagaucugcaucuga

SEQ ID NO: 97854 - RNA, 1698 nt, Artificial Sequence
  derived and/or modified sequence opt2 from hemagglutinin__InfluenzaA__ADV69083
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaacgucaccggcgucuccuccuccugcucccacaacggcaaguccuccuucuaccgcaaccuccucuggcucaccgucaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucauccucgaggccaacggcaaccucaucgccccccgcuacgccuucgagcucuccaagggccucggcuccggcaucaucaccuccaacgcccccaugggcgagugcaacgccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97855 - RNA, 1698 nt, Artificial Sequence
  derived and/or modified sequence opt2 from hemagglutinin__InfluenzaA__ADV69084
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaacgucaccggcgucuccuccuccugcucccacaacggcaaguccuccuucuaccgcaaccuccucuggcucaccgucaagaacggccucuaccccaaccucuccaaguccuacaccaacaagaaggagaaggagguccucauccucuggggcguccaccaccccuccaacauccgcgaccagcgcgcccucuacuacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccgacgcccccaugggcgagugcaacgccaagugccagaccccccagggcgccaucaacuccucccuccccuuccagaacguccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaagaucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97856 - RNA, 1698 nt, Artificial Sequence
  derived and/or modified sequence opt2 from hemagglutinin__InfluenzaA__ADV69085
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaaguccuccuucuaccgcaaccuccucuggcucaccaugaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccucccuccccuuccagaacguccaccccgucaccaucggcgagugccccaaguacguccgcuccuccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaagaucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97857 - RNA, 1698 nt, Artificial Sequence
  derived and/or modified sequence opt2 from hemagglutinin__InfluenzaA__ADV69086
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaagcacaccgucaccggcgucuccgccuccugcucccacaacggcaaguccuccuucuaccgcaaccuccucuggcucaccggcaagaacggccucuaccccaaccucuccaaguccuacaccaacgacaaggagaaggagguccucguccucuggggcguccaccaccccuccaacaucggcgaccagcgcgcccucuaccacaaggagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcaacaccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucucccucggcgccaucugcuucuggaugugcuccaacggcucccuccagugccgcaucugcaucuga

SEQ ID NO: 97858 - RNA, 1698 nt, Artificial Sequence
  derived and/or modified sequence opt2 from hemagglutinin__InfluenzaA__ADV69087
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaacggcgucuccuccuccugcucccacaacggcgaguccuccuucuaccgcaaccuccucuggcucaccgucaaggacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccucccuccccuuccagaacguccaccccgucaccaucggcgagugccccaaguacguccgcuccaccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaagaucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97859 - RNA, 1698 nt, Artificial Sequence
  derived and/or modified sequence opt2 from hemagglutinin__InfluenzaA__ADV69088
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucaccggcuggauccucggcaaccccgagugcgagcuccucaucuccaagaaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaacgucaacggcgucuccgccuccugcucccacaacggcaaguccuccuucuaccgcaaccuccucuggcucaccggcaagaacggccucuaccccucccucaccaaguccuacgccaacgacaaggagaaggagguccucauccucuggggcguccaccaccccuccaacaucggcgaccagcgcacccucuaccacaccgagaacgccuacgucuccgucauguccucccacuacucccgccgcuucacccccgagaucuccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccuccgcccccauggacgccugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgcccuccacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagauccagcucaagaacaacgccaaggagaucggcaacggcugcuucgaguucuaccacaagugcaacaacgagugcauggaguccguccgcaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97860 - RNA, 1698 nt, Artificial Sequence
  derived and/or modified sequence opt2 from hemagglutinin__InfluenzaA__ADV69089
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaagaaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaacgucaacggcgucuccgccuccugcucccacaacggcaaguccuccuucuaccgcaaccuccucuggcucaccggcaagaacggccucuaccccaaccucaccaaguccuacgccaacaacaaggagaaggagguccucauccucuggggcguccaccaccccuccaacaucggcgaccagcgcacccucuaccacaccgagaacgccuacgucuccgucauguccucccacuacucccgccgcuucacccccgagaucaccaagcgccccaagauccgcgaccaggagggccgcaucaacuacuacuggacccuccucgagcccggcgacaccaucaucuacgaggccaacggcaaccucaucgcccccugguacgccuucgcccucucccgcggcuucggcuccggcaucaucaccuccuccgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucaacggcugguacggcuaccgccuccacaacgaccagggcuccggcuacgccgccgaccagaaguccacccagaacgcccucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagaugcucguccuccucgagaacgagcgcacccucgacuuccacgacuccaacgucaagucccucuacgagcgcgucaagauccagcucaagaacaacgccaaggagaucggcaacggcugcuucgaguucuaccacaagugcaacaacgagugcauggaguccguccgcaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97861 - RNA, 1698 nt, Artificial Sequence
  derived and/or modified sequence opt2 from hemagglutinin__InfluenzaA__ADV69090
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucacccgcaagaacggccucuaccccaaccucuccaaguccuacgccaacaacaaggagaaggagguccucguccucuggggcguccaccacccccccaaccucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97862 - RNA, 1698 nt, Artificial Sequence
  derived and/or modified sequence opt2 from hemagglutinin__InfluenzaA__ADV69091
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccgccuccugcucccacaacggcaaguccuccuucuaccgcaaccuccucuggcucacccgcaagaacggccucuaccccaaccucuccaaguccuacaccaacgacaaggagaaggagguccucguccucuggggcguccaccaccccuccaacaucggcgaccagcgcgcccucuaccacaaggagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcaacaccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucucccucggcgccaucugcuucuggaugugcuccaacggcucccuccagugccgcaucugcaucuga

SEQ ID NO: 97863 - RNA, 1698 nt, Artificial Sequence
  derived and/or modified sequence opt2 from hemagglutinin__InfluenzaA__ADV69092
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcaacgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacaccaacgacaaggagaaggagguccucguccucuggggcguccaccaccccuccaacaucggcgaccagcgcgcccucuaccacaaggagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcaacaccaagugccagaccccccagggcgccaucaacuccucccuccccuuccagaacguccaccccgucaccaucggcgagugccccaaguacgucaaguccgccaagcuccgcauggucaccggccuccgcaacacccucuccauccaguccaagggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccauggaggucuaccagauccucgccaucuacuccaccgucgccuccucccucgucuuccucgucucccucggcgccaucugcuucuggaugugcuccaacggcucccuccagugccgcaucugcaucuga

SEQ ID NO: 97864 - RNA, 1698 nt, Artificial Sequence
  derived and/or modified sequence opt2 from hemagglutinin__InfluenzaA__ADV69093
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacgucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaaguccuccuucuaccgcaaccuccucuggcucaccgucaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagcgcgucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97865 - RNA, 1698 nt, Artificial Sequence
  derived and/or modified sequence opt2 from hemagglutinin__InfluenzaA__ADV69094
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaaguccuccuucuaccgcaaccuccucuggcucaccgucaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcaugguccacggcugguacggcuaccaccaccagaacgagcagggcuccggcuacgccgccgagcagcaguccacccaguacgccaucaacggcaucaccaacaaggucaacuccgucaucgagaagaugaacacccaguucaccgccgucggcaaggaguucaacaagcucgagcgccgcauggagaaccucaacaagcgcgucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97866 - RNA, 1698 nt, Artificial Sequence
  derived and/or modified sequence opt2 from hemagglutinin__InfluenzaA__ADV69095
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagccccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaacggcgucuccuccuccugcucccacaacggcgaguccuccuucuaccgcaaccuccucuggcucaccgucaaggacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccucccuccccuuccagaacguccaccccgucaccaucggcgagugccccaaguacguccgcuccaccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaagaucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97867 - RNA, 1698 nt, Artificial Sequence
  derived and/or modified sequence opt2 from hemagglutinin__InfluenzaA__ADV69096
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacgucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaaguccuccuucuaccgcaaccuccucuggcucaccgucaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagacccccaagggcgccaucaacuccucccuccccuuccagaacguccaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgaguccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97868 - RNA, 1698 nt, Artificial Sequence
  derived and/or modified sequence opt2 from hemagglutinin__InfluenzaA__ADV69097
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaagaaguccugguccuacaucgucgagacccccaaccccggcaacggcgccugcuaccccggcuacuucgccgacuacgaggagcuccgcgagcagcucuccuccgucuccuccuucgagcgcuucgagaucuuccccaaggaguccuccugguccaaccacaacgucaacggcgucuccgccuccugcucccacaacggcaaguccuccuucuaccgcaaccuccucuggcucaccggcaagaacggccucuaccccacccucaccaaguccuacgccaacgacaaggagaaggagguccucauccucuggggcguccaccaccccuccaacaucggcgaccagcgcacccucuaccacaccgagaacgccuacgucuccgucauguccucccacuacucccgccgcuucacccccgagaucuccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacgagaucaccaacaaggagaacuccgucaucgagaagaugaacacccaguucaccuccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagauccagcucaagaacaacgccaaggagaucggcaacggcugcuucgaguucuaccacaagugcaacaacgagugcauggaguccguccgcaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97869 - RNA, 1698 nt, Artificial Sequence
  derived and/or modified sequence opt2 from hemagglutinin__InfluenzaA__ADV69098
augaaggucaagcucaucguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaacuccuccuucuaccgcaaccuccucuggcucaccgucaagaacggccucuaccccaaccucuccaaguccuacaccaacaagaaggagaaggagguccucguccucuggggcguccaccaccccuccaacaucgaggaccagcgcgcccucuaccacaccgagaacgccuacgucuccgucgucuccucccacuacucccgccgcuucaaccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccaaccuccccuuccagaacguccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcauggucgacggcugguacggcuaccaccaccacaacgagcagggcuccggcuacgccgccaaccagaaguccacccccaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97870 - RNA, 1698 nt, Artificial Sequence
  derived and/or modified sequence opt2 from hemagglutinin__InfluenzaA__ADV69099
augaaggucaagcucaucguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaacuccuccuucuaccgcaaccuccucuggcucaccgucaagaacggccucuaccccaaccucuccaaguccuacaccaacaagaaggagaaggagguccucguccucuggggcguccaccaccccuccaacaucgaggaccagcgcgcccucuaccacaccgagaacgccuacgucuccgucgucuccucccacuacucccgccgcuucaaccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccaaccuccccuuccagaacguccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcauggucaacggcugguacggcuaccaccaccacaacgagcagggcuccggcuacgccgccaaccagcaguccccccccaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97871 - RNA, 1698 nt, Artificial Sequence
  derived and/or modified sequence opt2 from hemagglutinin__InfluenzaA__ADV69100
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaagcccgagaacggcaccugcuaccccggcgaguucgccgacuacgaggagcuccgcgagcagcucuccuccgucuccuccuucgagcgcuucgagaucuuccccaaggaguccuccuggcccaaccacaccgccgccggcgucuccgccuccugcucccacaacggcgagcgcuccuucuacaagaaccucaucuggcucaccgucaagaacggccucuaccccaaccucuccaaguccuacaagaacgacaaggagaaggagguccucauccucuggggcguccaccacccccccaacaucgagaaccagcgcacccucuaccacaccgagaacaccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucucccgcggccucggcuccggcaucgucaccuccaacgcccccauggacaagugcgacgccaagugccagaccccccacggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97872 - RNA, 1698 nt, Artificial Sequence
  derived and/or modified sequence opt2 from hemagglutinin__InfluenzaA__ADV69101
augaaggucaagcuccucauccucuucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcgagcgcuccuucuaccgcaaccucaucuggcucaccgucaagaacggccucuaccccaaccucuccaaguccuacgagaacgacaaggagaaggagguccucauccucuggggcguccaccacccccccaacaucgagaaccagcgcacccucuaccacaccgagaacgccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucucccgcggccucggcuccggcaucaucaccuccaacgcccccauggacgagugcgacuccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacccccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97873 - RNA, 1698 nt, Artificial Sequence
  derived and/or modified sequence opt2 from hemagglutinin__InfluenzaA__ADV69102
augaaggucaagcuccucauccucuucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcgagcgcuccuucuaccgcaaccucaucuggcucaccgucaagaacggccucuaccccaaccucuccaaguccuacgagaacgacaaggagaaggagguccucauccucuggggcguccaccacccccccaacaucgagaaccagcgcacccucuaccacaccgagaacgccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucuccaccggccucggcuccggcaucaucaccuccaacgcccccauggacgagugcgacuccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97874 - RNA, 1698 nt, Artificial Sequence
  derived and/or modified sequence opt2 from hemagglutinin__InfluenzaA__ADV69103
augaaggucaagcucaugguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaacgucaccggcgucuccuccuccugcucccacaacggcaaguccuccuucuaccgcaaccuccucuggcucaccgucaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgagcucuccaagggcuucggcuccggcaucaucaccuccaacgcccccaucggcgagugcaacgccaagugccagaccccccagggcgccaucaacuccucccuccccuuccagaacgucaaccccgucaccaucggcgagugccccaaguacgucaaguccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97875 - RNA, 1698 nt, Artificial Sequence
  derived and/or modified sequence opt2 from hemagglutinin__InfluenzaA__ADV69104
augaaggucaagcuccucauccucuucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcgagcgcuccuucuaccgcaaccucaucuggcucaccgucaagaacggccucuaccccaaccucuccaaguccuacgagaacgacaaggagaaggagguccucauccucuggggcguccaccacccccccaacaucgagaaccagcgcacccucuaccacaccgagaacgccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucucccgcggccucggcuccggcaucaucaccuccaacgcccccauggacgagugcgacuccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97876 - RNA, 1698 nt, Artificial Sequence
  derived and/or modified sequence opt2 from hemagglutinin__InfluenzaA__ADV69105
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccgccggcgucuccgccuccugcucccacaacggcgagcgcuccuucuaccgcaaccucaucuggcucaccgucaagaacggccucuaccccaaccucuccaaguccuacaagaacgacaaggagaaggagguccucaucaucuggggcguccaccacccccccaacaucgagaaccagcgcacccucuaccacaccgagaacgccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucucccgcggccucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97877 - RNA, 1698 nt, Artificial Sequence
  derived and/or modified sequence opt2 from hemagglutinin__InfluenzaA__ADV69106
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccggcaacggcgccugcuaccccggcuacuucgccgacuacgaggagcuccgcgagcagcucuccuccgucuccuccuucgagcgcuucgagauguuccccaaggaguccuccuggcccaaccacaacgucaacggcgucuccgccuccugcucccacaacggcaaguccuccuucuaccgcaaccuccucuggcucacccgcaagaacggccucuaccccaaccucaccaaguccuacgccaacaacaacgacaaggagguccucauccucuggggcguccaccaccccuccaacaucggcgaccagcgcacccucuaccacaccgagaacgccuacgucuccgucauguccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcuccuucggcuccggcaucaucaccuccuccgcccccauggacgagugcgacgccaagugccagaccccccagggcgccaucaacuccucccuccccuuccagaacguccaccccgucaccaucggcgagugccccaaguacguccgcuccgccaagcucaagauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagauccagcucaagaacaacgccaaggagaucggcaacggcugcuucgaguucuaccacaagugcaacaacgagugcauggaguccguccgcaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97878 - RNA, 1698 nt, Artificial Sequence
  derived and/or modified sequence opt2 from hemagglutinin__InfluenzaA__ADV69107
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaacuccgacaacggcgccugcuaccccggccaguucaccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccucaucuggcucaccgucaagaacggccucuaccccaaccucuccaaguccuacgagaacgacaaggagaaggagguccucauccucuggggcguccaccacccccccaacaucggcgaccagcgcacccucuaccacaccgagaacgccuacaucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggccucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccguccgcaacggcaccuacgacuaccccaaguacuccgaggaguccaagcucaaccgcgagaagaucgacggcgucaagcucgacuccaugggcgucuaccgcauccucgccaucuacuccaccgccgccuccucccucguccuccucgucucccucggcgccaucuccuucuggaugugcuccaacggcucccuccagugccgcaucugcaucuga

SEQ ID NO: 97879 - RNA, 1698 nt, Artificial Sequence
  derived and/or modified sequence opt2 from hemagglutinin__InfluenzaA__ADV69108
augaaggucaagcuccucguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcuccugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucaagcgcuucgagaucuuccccaaggaguccuccuggcccaaccacaccgucaccggcgucuccuccuccugcucccacaacggcaaguccuccuucuaccgcaaccuccucuggcucaccaugaagaacggccucuaccccaaccucuccaaguccuacaccaacaagaaggagaaggagguccucguccucuggggcguccaccaccccuccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccgaggacaccaucaucuucgaggccaacggcaaccucaucgccccccgcuacgccuucgagcucuccaagggcuucggcuccggcaucaucaccuccaacgcccccaugggcgagugcaacgccaagugccagaccccccagggcgccaucaacuccucccuccccuuccagaacguccaccccgucaccaucggcgagugccccaaguacguccgcuccuccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagcaguccacccagaacgccaucaacggcaucaccaacaaggucaacuccgucaucgagaagaugaacacccaguucaccgccgucggcaaggaguucaacaagcucgagcgccgcauggagaaccucaacaagaagaucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuacaacauccucgccaucuacuccaccgucgccuccucccucguccuccucgucucccucggcgccaucuccuucuggaugugcuccaacggcucccuccagugccgcaucugcaucuga

SEQ ID NO: 97880 - RNA, 1698 nt, Artificial Sequence
  derived and/or modified sequence opt2 from hemagglutinin__InfluenzaA__ADV69109
augaaggucaagcuccucauccuccucugcaccuucaaggccaccuacgccgacaccaucugcaucggcuaccacgccaacaacuccaccgagaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaagaaguccugguccuacaucgucgagacccccaaccccgagaacggcgccugcuaccccggcgaguucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcgagcgcuccuucuaccgcaaccucaucuggcucaccgucaagaacggccucuaccccaaccucuccaaguccuacgagaacgacaagaagaaggagguccucauccucuggggcguccaccacccccccaacaucgagaaccagcgcacccucuaccacaccgagaacgccuacgucuccgucgucuccucccacuacuccggccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucacccucucccgcggccucggcuccggcaucaucaccuccaacgcccccauggacgagugcgacgccaagugccagacccccaagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagucccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 97881 - RNA, 1701 nt, Artificial Sequence
  derived and/or modified sequence opt2 from hemagglutinin__InfluenzaA__ADV76579
augaagaccaucaucgcccucuccuacauccucugccucgucuucgcccagaagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97882 - RNA, 1701 nt, Artificial Sequence; identical to SEQ ID NO: 95100
  derived and/or modified sequence opt2 from hemagglutinin__InfluenzaA__ADV76587

SEQ ID NO: 97883 - RNA, 1701 nt, Artificial Sequence; identical to SEQ ID NO: 95100
  derived and/or modified sequence opt2 from hemagglutinin__InfluenzaA__ADV76598

SEQ ID NO: 97884 - RNA, 1701 nt, Artificial Sequence; identical to SEQ ID NO: 94923
  derived and/or modified sequence opt2 from hemagglutinin__InfluenzaA__ADV76609

SEQ ID NO: 97885 - RNA, 1701 nt, Artificial Sequence; identical to SEQ ID NO: 95100
  derived and/or modified sequence opt2 from hemagglutinin__InfluenzaA__ADV76620

SEQ ID NO: 97886 - RNA, 1701 nt, Artificial Sequence
  derived and/or modified sequence opt2 from hemagglutinin__InfluenzaA__ADV76631
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccauggucaagcccggcgacauccuccucaucaacuccaccggcaaccucaucgccccccgcggcuacuucaagauccgcuccggcaaguccuccaucaugcgcuccgacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaaggccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97887 - RNA, 1701 nt, Artificial Sequence; identical to SEQ ID NO: 97104
  derived and/or modified sequence opt2 from hemagglutinin__InfluenzaA__ADV76642

SEQ ID NO: 97888 - RNA, 1701 nt, Artificial Sequence; identical to SEQ ID NO: 97108
  derived and/or modified sequence opt2 from hemagglutinin__InfluenzaA__ADV76664

SEQ ID NO: 97889 - RNA, 1701 nt, Artificial Sequence
  derived and/or modified sequence opt2 from hemagglutinin__InfluenzaA__ADV76673
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccucuccucccgcaucuccaucuacuggaccaucgucaaccccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaaggccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 97890 - RNA, 1701 nt, Artificial Sequence
  derived and/or modified sequence opt2 from hemagglutinin__InfluenzaA__ADV76682
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcgaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97891 - RNA, 1701 nt, Artificial Sequence; identical to SEQ ID NO: 95125
  derived and/or modified sequence opt2 from hemagglutinin__InfluenzaA__ADV76694

SEQ ID NO: 97892 - RNA, 1701 nt, Artificial Sequence; identical to SEQ ID NO: 94923
  derived and/or modified sequence opt2 from hemagglutinin__InfluenzaA__ADV76705

SEQ ID NO: 97893 - RNA, 1701 nt, Artificial Sequence; identical to SEQ ID NO: 95125
  derived and/or modified sequence opt2 from hemagglutinin__InfluenzaA__ADV76716

SEQ ID NO: 97894 - RNA, 1701 nt, Artificial Sequence
  derived and/or modified sequence opt2 from hemagglutinin__InfluenzaA__ADV76727
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaaguccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97895 - RNA, 1701 nt, Artificial Sequence
  derived and/or modified sequence opt2 from hemagglutinin__InfluenzaA__ADV91009
augaaggccauccucgccguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucgaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97896 - RNA, 1701 nt, Artificial Sequence
  derived and/or modified sequence opt2 from hemagglutinin__InfluenzaA__ADV91010
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaccgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97897 - RNA, 1701 nt, Artificial Sequence
  derived and/or modified sequence opt2 from hemagglutinin__InfluenzaA__ADW01407
auggaggccaagcucuucguccucuucugcgccuucaccgcccucaaggccgacaccaucugcgucggcuaccacgccaacaacuccaccgacaccgucgacaccauccucgagaagaacgucaccgucacccacuccgucaaccuccucgagaacucccacaacggcaagcucugcucccucaacggcaagaucccccuccagcucggcaacugcaacgucgccggcuggauccucggcaaccccaagugcgaccuccuccucaccgccaacuccugguccuacaucaucgagaccuccaacuccaagaacggcgccugcuaccccggcgaguucgccgacuacgaggagcucaaggagcagcucuccaccgucuccuccuucgagcgcuucgagaucuuccccaaggccaccuccuggcccaaccacgacaccacccgcggcaccaccgucgccugcucccacuccggcgccaacuccuucuaccgcaaccuccucuggaucgucaagaagggcaacuccuaccccaagcucuccaaguccuacaccaacaacaagggcaaggagguccucgucaucuggggcguccaccacccccccaccgacuccgaccagcagacccucuaccagaacaaccacaccuacgucuccgucggcuccuccaaguacuacaagcgccucacccccgagaucgucgcccgccccaagguccgcgagcaggccggccgcaugaacuacuacuggacccuccucgaccagggcgacaccaucaccuucgaggccaccggcaaccucaucgcccccuggcacgccuucgcccucaagaagggcuccuccuccggcaucaugcgcuccgacgcccagguccacaacugcaccaccaagugccagaccccccacggcgcccucaagggcaaccuccccuuccagaacguccaccccgucaccaucggcgagugccccaaguacgucaaguccacccagcuccgcauggccaccggccuccgcaacauccccuccauccagucccgcggccucuucggcgccaucgccggcuucaucgagggcggcuggaccggcauggucgacggcugguacggcuaccaccaccgcaacgagcagggcuccggcuacgccgccgaccagaaguccacccagaucgccaucgacggcaucuccaacaaggucaacuccgucaucgagaagaugaacauccaguucaccuccgucggcaaggaguucaacucccucgagaagcgcauggagaaccucaacaagaaggucgacgacggcuuccucgacgucuggaccuacaacgccgagcuccucauccuccucgagaacgagcgcacccucgacuuccacgaccucaacgucaagaaccucuacgagaaggucaagucccagcuccgcaacaacgccaaggagaucggcaacggcugcuucgaguucuaccacaagugcgacaacgagugcauggaguccgucaagaacggcaccuacaacuaccccaaguacuccgaggaguccaagcucaaccgcgaggagaucgacggcgucaagcucgaguccaugggcauccaccagauccucgccaucuacuccaccgucgccuccucccucguccuccucgucucccucggcgccaucuccuucuggaugugcuccaacggcucccuccagugccgcgucugcaucuga

SEQ ID NO: 97898 - RNA, 1698 nt, Artificial Sequence; identical to SEQ ID NO: 94643
  derived and/or modified sequence opt2 from hemagglutinin__InfluenzaA__ADW09101

SEQ ID NO: 97899 - RNA, 1698 nt, Artificial Sequence
  derived and/or modified sequence opt2 from hemagglutinin__InfluenzaA__ADW09111
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgaccagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97900 - RNA, 1698 nt, Artificial Sequence
  derived and/or modified sequence opt2 from hemagglutinin__InfluenzaA__ADW09120
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucuccaagggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97901 - RNA, 1698 nt, Artificial Sequence; identical to SEQ ID NO: 95128
  derived and/or modified sequence opt2 from hemagglutinin__InfluenzaA__ADW09131

SEQ ID NO: 97902 - RNA, 1698 nt, Artificial Sequence
  derived and/or modified sequence opt2 from hemagglutinin__InfluenzaA__ADW09153
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccaggacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97903 - RNA, 1698 nt, Artificial Sequence; identical to SEQ ID NO: 95128
  derived and/or modified sequence opt2 from hemagglutinin__InfluenzaA__ADW09164

SEQ ID NO: 97904 - RNA, 1698 nt, Artificial Sequence
  derived and/or modified sequence opt2 from hemagglutinin__InfluenzaA__ADW09186
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97905 - RNA, 1698 nt, Artificial Sequence; identical to SEQ ID NO: 94643
  derived and/or modified sequence opt2 from hemagglutinin__InfluenzaA__ADW09197

SEQ ID NO: 97906 - RNA, 1698 nt, Artificial Sequence; identical to SEQ ID NO: 95128
  derived and/or modified sequence opt2 from hemagglutinin__InfluenzaA__ADW09208

SEQ ID NO: 97907 - RNA, 1698 nt, Artificial Sequence; identical to SEQ ID NO: 95128
  derived and/or modified sequence opt2 from hemagglutinin__InfluenzaA__ADW09219

SEQ ID NO: 97908 - RNA, 1698 nt, Artificial Sequence; identical to SEQ ID NO: 94643
  derived and/or modified sequence opt2 from hemagglutinin__InfluenzaA__ADW09230

SEQ ID NO: 97909 - RNA, 1698 nt, Artificial Sequence
  derived and/or modified sequence opt2 from hemagglutinin__InfluenzaA__ADW09241
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagaugcgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97910 - RNA, 1698 nt, Artificial Sequence; identical to SEQ ID NO: 95128
  derived and/or modified sequence opt2 from hemagglutinin__InfluenzaA__ADW09252

SEQ ID NO: 97911 - RNA, 1698 nt, Artificial Sequence
  derived and/or modified sequence opt2 from hemagglutinin__InfluenzaA__ADW09274
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaagcccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97912 - RNA, 1698 nt, Artificial Sequence
  derived and/or modified sequence opt2 from hemagglutinin__InfluenzaA__ADW09285
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaccuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97913 - RNA, 1698 nt, Artificial Sequence; identical to SEQ ID NO: 95128
  derived and/or modified sequence opt2 from hemagglutinin__InfluenzaA__ADW09296

SEQ ID NO: 97914 - RNA, 1698 nt, Artificial Sequence; identical to SEQ ID NO: 94643
  derived and/or modified sequence opt2 from hemagglutinin__InfluenzaA__ADW09307

SEQ ID NO: 97915 - RNA, 1698 nt, Artificial Sequence
  derived and/or modified sequence opt2 from hemagglutinin__InfluenzaA__ADW09327
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97916 - RNA, 1698 nt, Artificial Sequence; identical to SEQ ID NO: 95128
  derived and/or modified sequence opt2 from hemagglutinin__InfluenzaA__ADW10483

SEQ ID NO: 97917 - RNA, 1698 nt, Artificial Sequence
  derived and/or modified sequence opt2 from hemagglutinin__InfluenzaA__ADW10494
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97918 - RNA, 1698 nt, Artificial Sequence; identical to SEQ ID NO: 95128
  derived and/or modified sequence opt2 from hemagglutinin__InfluenzaA__ADW10505

SEQ ID NO: 97919 - RNA, 1698 nt, Artificial Sequence; identical to SEQ ID NO: 95128
  derived and/or modified sequence opt2 from hemagglutinin__InfluenzaA__ADW10516

SEQ ID NO: 97920 - RNA, 1698 nt, Artificial Sequence
  derived and/or modified sequence opt2 from hemagglutinin__InfluenzaA__ADW10527
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggccucggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97921 - RNA, 1698 nt, Artificial Sequence
  derived and/or modified sequence opt2 from hemagglutinin__InfluenzaA__ADW10538
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucauguccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97922 - RNA, 1698 nt, Artificial Sequence; identical to SEQ ID NO: 95128
  derived and/or modified sequence opt2 from hemagglutinin__InfluenzaA__ADW10549

SEQ ID NO: 97923 - RNA, 1698 nt, Artificial Sequence
  derived and/or modified sequence opt2 from hemagglutinin__InfluenzaA__ADW10560
augaaggucaagcuccucguccuccucugcaccuucaccgccaccuacgccgacaccaucugcaucggcuaccacgccaacaacuccaccgacaccgucgacaccgucuucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccgacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97924 - RNA, 1698 nt, Artificial Sequence; identical to SEQ ID NO: 97465
  derived and/or modified sequence opt2 from hemagglutinin__InfluenzaA__ADW10571

SEQ ID NO: 97925 - RNA, 1698 nt, Artificial Sequence; identical to SEQ ID NO: 94643
  derived and/or modified sequence opt2 from hemagglutinin__InfluenzaA__ADW10582

SEQ ID NO: 97926 - RNA, 1698 nt, Artificial Sequence; identical to SEQ ID NO: 95128
  derived and/or modified sequence opt2 from hemagglutinin__InfluenzaA__ADW10593

SEQ ID NO: 97927 - RNA, 1698 nt, Artificial Sequence; identical to SEQ ID NO: 95128
  derived and/or modified sequence opt2 from hemagglutinin__InfluenzaA__ADW10604

SEQ ID NO: 97928 - RNA, 1698 nt, Artificial Sequence; identical to SEQ ID NO: 95128
  derived and/or modified sequence opt2 from hemagglutinin__InfluenzaA__ADW10615

SEQ ID NO: 97929 - RNA, 1698 nt, Artificial Sequence
  derived and/or modified sequence opt2 from hemagglutinin__InfluenzaA__ADW10626
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccuccaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97930 - RNA, 1698 nt, Artificial Sequence
  derived and/or modified sequence opt2 from hemagglutinin__InfluenzaA__ADW10721
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagcgcacccucuaccacaccgagaacgccuacgucuccgucgucuccucccacuacucccgcaaguucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97931 - RNA, 1698 nt, Artificial Sequence
  derived and/or modified sequence opt2 from hemagglutinin__InfluenzaA__ADW10743
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacaccuacgucuccgucgucuccucccacuacucccgcaaguucacccccgagaucgccaagcgccccaagauccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgucaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97932 - RNA, 1698 nt, Artificial Sequence
  derived and/or modified sequence opt2 from hemagglutinin__InfluenzaA__ADW10754
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccguccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97933 - RNA, 1698 nt, Artificial Sequence
  derived and/or modified sequence opt2 from hemagglutinin__InfluenzaA__ADW10765
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccacaccgagaacgccuacgucuccgucgucuccucccacuacucccgcaaguucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97934 - RNA, 1698 nt, Artificial Sequence
  derived and/or modified sequence opt2 from hemagglutinin__InfluenzaA__ADW10776
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacgacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97935 - RNA, 1698 nt, Artificial Sequence
  derived and/or modified sequence opt2 from hemagglutinin__InfluenzaA__ADW10787
augaaggucaagauccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97936 - RNA, 1698 nt, Artificial Sequence
  derived and/or modified sequence opt2 from hemagglutinin__InfluenzaA__ADW10798
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcgucgagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97937 - RNA, 1698 nt, Artificial Sequence; identical to SEQ ID NO: 97933
  derived and/or modified sequence opt2 from hemagglutinin__InfluenzaA__ADW10809

SEQ ID NO: 97938 - RNA, 1698 nt, Artificial Sequence; identical to SEQ ID NO: 95128
  derived and/or modified sequence opt2 from hemagglutinin__InfluenzaA__ADW10820

SEQ ID NO: 97939 - RNA, 1698 nt, Artificial Sequence; identical to SEQ ID NO: 94643
  derived and/or modified sequence opt2 from hemagglutinin__InfluenzaA__ADW10831

SEQ ID NO: 97940 - RNA, 1698 nt, Artificial Sequence
  derived and/or modified sequence opt2 from hemagglutinin__InfluenzaA__ADW10842
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucgcccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97941 - RNA, 1698 nt, Artificial Sequence; identical to SEQ ID NO: 97484
  derived and/or modified sequence opt2 from hemagglutinin__InfluenzaA__ADW10853

SEQ ID NO: 97942 - RNA, 1698 nt, Artificial Sequence; identical to SEQ ID NO: 97933
  derived and/or modified sequence opt2 from hemagglutinin__InfluenzaA__ADW10864

SEQ ID NO: 97943 - RNA, 1698 nt, Artificial Sequence; identical to SEQ ID NO: 97933
  derived and/or modified sequence opt2 from hemagglutinin__InfluenzaA__ADW10875

SEQ ID NO: 97944 - RNA, 1698 nt, Artificial Sequence; identical to SEQ ID NO: 95128
  derived and/or modified sequence opt2 from hemagglutinin__InfluenzaA__ADW10886

SEQ ID NO: 97945 - RNA, 1698 nt, Artificial Sequence
  derived and/or modified sequence opt2 from hemagglutinin__InfluenzaA__ADW10897
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacaccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggaggucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 97946 - RNA, 1701 nt, Artificial Sequence
  derived and/or modified sequence opt2 from hemagglutinin__InfluenzaA__ADW23115
augaagaccaucaucgcccucuccuacauccucugccucgucuucgcccagaagcuccccggcaacggcaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97947 - RNA, 1701 nt, Artificial Sequence
  derived and/or modified sequence opt2 from hemagglutinin__InfluenzaA__ADW54481
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97948 - RNA, 1701 nt, Artificial Sequence
  derived and/or modified sequence opt2 from hemagglutinin__InfluenzaA__ADW54512
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97949 - RNA, 1701 nt, Artificial Sequence
  derived and/or modified sequence opt2 from hemagglutinin__InfluenzaA__ADW54527
augaaggccauccucgucguccuccucuacaccuucgccaccgccuccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97950 - RNA, 1701 nt, Artificial Sequence; identical to SEQ ID NO: 97947
  derived and/or modified sequence opt2 from hemagglutinin__InfluenzaA__ADW65825

SEQ ID NO: 97951 - RNA, 1701 nt, Artificial Sequence
  derived and/or modified sequence opt2 from hemagglutinin__InfluenzaA__ADW82135
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguacaccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97952 - RNA, 1701 nt, Artificial Sequence; identical to SEQ ID NO: 97951
  derived and/or modified sequence opt2 from hemagglutinin__InfluenzaA__ADW82155

SEQ ID NO: 97953 - RNA, 1701 nt, Artificial Sequence; identical to SEQ ID NO: 97951
  derived and/or modified sequence opt2 from hemagglutinin__InfluenzaA__ADW82166

SEQ ID NO: 97954 - RNA, 1701 nt, Artificial Sequence; identical to SEQ ID NO: 97951
  derived and/or modified sequence opt2 from hemagglutinin__InfluenzaA__ADW82177

SEQ ID NO: 97955 - RNA, 1701 nt, Artificial Sequence; identical to SEQ ID NO: 94181
  derived and/or modified sequence opt2 from hemagglutinin__InfluenzaA__ADW82188

SEQ ID NO: 97956 - RNA, 1701 nt, Artificial Sequence; identical to SEQ ID NO: 94181
  derived and/or modified sequence opt2 from hemagglutinin__InfluenzaA__ADW82198

SEQ ID NO: 97957 - RNA, 1701 nt, Artificial Sequence; identical to SEQ ID NO: 94181
  derived and/or modified sequence opt2 from hemagglutinin__InfluenzaA__ADW82208

SEQ ID NO: 97958 - RNA, 1701 nt, Artificial Sequence; identical to SEQ ID NO: 94181
  derived and/or modified sequence opt2 from hemagglutinin__InfluenzaA__ADW82218

SEQ ID NO: 97959 - RNA, 1701 nt, Artificial Sequence; identical to SEQ ID NO: 94181
  derived and/or modified sequence opt2 from hemagglutinin__InfluenzaA__ADW82228

SEQ ID NO: 97960 - RNA, 1701 nt, Artificial Sequence; identical to SEQ ID NO: 94181
  derived and/or modified sequence opt2 from hemagglutinin__InfluenzaA__ADW82238

SEQ ID NO: 97961 - RNA, 1701 nt, Artificial Sequence; identical to SEQ ID NO: 94181
  derived and/or modified sequence opt2 from hemagglutinin__InfluenzaA__ADW82248

SEQ ID NO: 97962 - RNA, 1701 nt, Artificial Sequence; identical to SEQ ID NO: 94181
  derived and/or modified sequence opt2 from hemagglutinin__InfluenzaA__ADW82258

SEQ ID NO: 97963 - RNA, 1701 nt, Artificial Sequence
  derived and/or modified sequence opt2 from hemagglutinin__InfluenzaA__ADW82268
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcauccaccagauccucgccaucuacuccaccgucgccuccucccucguccucgucgucucccucggcgccaucuccuucuggaugugcuccaacggcucccuccagugccgcaucugcaucuga

SEQ ID NO: 97964 - RNA, 1701 nt, Artificial Sequence; identical to SEQ ID NO: 97951
  derived and/or modified sequence opt2 from hemagglutinin__InfluenzaA__ADW93760

SEQ ID NO: 97965 - RNA, 1701 nt, Artificial Sequence
  derived and/or modified sequence opt2 from hemagglutinin__InfluenzaA__ADW95319
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97966 - RNA, 1701 nt, Artificial Sequence
  derived and/or modified sequence opt2 from hemagglutinin__InfluenzaA__ADW95332
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97967 - RNA, 1701 nt, Artificial Sequence
  derived and/or modified sequence opt2 from hemagglutinin__InfluenzaA__ADX21078
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguacaccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucauccgcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 97968 - RNA, 1701 nt, Artificial Sequence; identical to SEQ ID NO: 97967
  derived and/or modified sequence opt2 from hemagglutinin__InfluenzaA__ADX21088

SEQ ID NO: 97969 - RNA, 1701 nt, Artificial Sequence
  derived and/or modified sequence opt2 from hemagglutinin__InfluenzaA__ADX21098
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcuccaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcauccaccagauccucgccaucuacuccaccgucgccuccucccucguccucgucgucucccucggcgccaucuccuucuggaugugcuccaacggcucccuccagugccgcaucugcaucuga

SEQ ID NO: 97970 - RNA, 1701 nt, Artificial Sequence; identical to SEQ ID NO: 95100
  derived and/or modified sequence opt2 from hemagglutinin__InfluenzaA__ADX36109

SEQ ID NO: 97971 - RNA, 1701 nt, Artificial Sequence
  derived and/or modified sequence opt2 from hemagglutinin__InfluenzaA__ADX96278
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97972 - RNA, 1701 nt, Artificial Sequence
  derived and/or modified sequence opt2 from hemagglutinin__InfluenzaA__ADX96288
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagcagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97973 - RNA, 1701 nt, Artificial Sequence
  derived and/or modified sequence opt2 from hemagglutinin__InfluenzaA__ADX96298
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgucauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 97974 - RNA, 1701 nt, Artificial Sequence; identical to SEQ ID NO: 95778
  derived and/or modified sequence opt2 from hemagglutinin__InfluenzaA__ADX96308

SEQ ID NO: 97975 - RNA, 1701 nt, Artificial Sequence
  derived and/or modified sequence opt2 from hemagglutinin__InfluenzaA__ADX96318
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97976 - RNA, 1701 nt, Artificial Sequence
  derived and/or modified sequence opt2 from hemagglutinin__InfluenzaA__ADX96328
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97977 - RNA, 1701 nt, Artificial Sequence
  derived and/or modified sequence opt2 from hemagglutinin__InfluenzaA__ADX96347
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97978 - RNA, 1701 nt, Artificial Sequence
  derived and/or modified sequence opt2 from hemagglutinin__InfluenzaA__ADX96357
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgucauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97979 - RNA, 1701 nt, Artificial Sequence; identical to SEQ ID NO: 97118
  derived and/or modified sequence opt2 from hemagglutinin__InfluenzaA__ADX96367

SEQ ID NO: 97980 - RNA, 1701 nt, Artificial Sequence
  derived and/or modified sequence opt2 from hemagglutinin__InfluenzaA__ADX96378
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97981 - RNA, 1701 nt, Artificial Sequence; identical to SEQ ID NO: 97980
  derived and/or modified sequence opt2 from hemagglutinin__InfluenzaA__ADX96398

SEQ ID NO: 97982 - RNA, 1701 nt, Artificial Sequence
  derived and/or modified sequence opt2 from hemagglutinin__InfluenzaA__ADX96408
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97983 - RNA, 1701 nt, Artificial Sequence; identical to SEQ ID NO: 94494
  derived and/or modified sequence opt2 from hemagglutinin__InfluenzaA__ADX96427

SEQ ID NO: 97984 - RNA, 1701 nt, Artificial Sequence
  derived and/or modified sequence opt2 from hemagglutinin__InfluenzaA__ADX96437
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgccucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 97985 - RNA, 1701 nt, Artificial Sequence; identical to SEQ ID NO: 94168
  derived and/or modified sequence opt2 from hemagglutinin__InfluenzaA__ADX96447

SEQ ID NO: 97986 - RNA, 1701 nt, Artificial Sequence; identical to SEQ ID NO: 94181
  derived and/or modified sequence opt2 from hemagglutinin__InfluenzaA__ADX96497

SEQ ID NO: 97987 - RNA, 1701 nt, Artificial Sequence
  derived and/or modified sequence opt2 from hemagglutinin__InfluenzaA__ADX96507
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 97988 - RNA, 1701 nt, Artificial Sequence; identical to SEQ ID NO: 97987
  derived and/or modified sequence opt2 from hemagglutinin__InfluenzaA__ADX96517

SEQ ID NO: 97989 - RNA, 1701 nt, Artificial Sequence
  derived and/or modified sequence opt2 from hemagglutinin__InfluenzaA__ADX96527
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuuccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 97990 - RNA, 1701 nt, Artificial Sequence; identical to SEQ ID NO: 94181
  derived and/or modified sequence opt2 from hemagglutinin__InfluenzaA__ADX96537

SEQ ID NO: 97991 - RNA, 1701 nt, Artificial Sequence; identical to SEQ ID NO: 94181
  derived and/or modified sequence opt2 from hemagglutinin__InfluenzaA__ADX96547

SEQ ID NO: 97992 - RNA, 1701 nt, Artificial Sequence; identical to SEQ ID NO: 95282
  derived and/or modified sequence opt2 from hemagglutinin__InfluenzaA__ADX96557

SEQ ID NO: 97993 - RNA, 1701 nt, Artificial Sequence; identical to SEQ ID NO: 94181
  derived and/or modified sequence opt2 from hemagglutinin__InfluenzaA__ADX96587

SEQ ID NO: 97994 - RNA, 1701 nt, Artificial Sequence; identical to SEQ ID NO: 94168
  derived and/or modified sequence opt2 from hemagglutinin__InfluenzaA__ADX96597

SEQ ID NO: 97995 - RNA, 1701 nt, Artificial Sequence; identical to SEQ ID NO: 94168
  derived and/or modified sequence opt2 from hemagglutinin__InfluenzaA__ADX96607

SEQ ID NO: 97996 - RNA, 1701 nt, Artificial Sequence
  derived and/or modified sequence opt2 from hemagglutinin__InfluenzaA__ADX96627
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 97997 - RNA, 1701 nt, Artificial Sequence; identical to SEQ ID NO: 94628
  derived and/or modified sequence opt2 from hemagglutinin__InfluenzaA__ADX96637

SEQ ID NO: 97998 - RNA, 1701 nt, Artificial Sequence; identical to SEQ ID NO: 94181
  derived and/or modified sequence opt2 from hemagglutinin__InfluenzaA__ADX96647

SEQ ID NO: 97999 - RNA, 1701 nt, Artificial Sequence; identical to SEQ ID NO: 94168
  derived and/or modified sequence opt2 from hemagglutinin__InfluenzaA__ADX96657

SEQ ID NO: 98000 - RNA, 1701 nt, Artificial Sequence; identical to SEQ ID NO: 94181
  derived and/or modified sequence opt2 from hemagglutinin__InfluenzaA__ADX96667

SEQ ID NO: 98001 - RNA, 1701 nt, Artificial Sequence
  derived and/or modified sequence opt2 from hemagglutinin__InfluenzaA__ADX96677
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggaccgucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98002 - RNA, 1701 nt, Artificial Sequence
  derived and/or modified sequence opt2 from hemagglutinin__InfluenzaA__ADX96687
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucuacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98003 - RNA, 1701 nt, Artificial Sequence; identical to SEQ ID NO: 94181
  derived and/or modified sequence opt2 from hemagglutinin__InfluenzaA__ADX96697

SEQ ID NO: 98004 - RNA, 1701 nt, Artificial Sequence
  derived and/or modified sequence opt2 from hemagglutinin__InfluenzaA__ADX96707
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcgacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 98005 - RNA, 1701 nt, Artificial Sequence; identical to SEQ ID NO: 95341
  derived and/or modified sequence opt2 from hemagglutinin__InfluenzaA__ADX96727

SEQ ID NO: 98006 - RNA, 1701 nt, Artificial Sequence
  derived and/or modified sequence opt2 from hemagglutinin__InfluenzaA__ADX96737
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaaggucaaggagcaggagggccgcaugaacuacuacuggacccucgucgagcccggcgacaagaucaccuucgaggccaccggcaaccucgucgucccccgcuacgccuucgccauggagcgcaaggccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucaucucccucggcgccaucuccuucuggaugugcuccaccggcucccuccagugccgcaucugcaucuga

SEQ ID NO: 98007 - RNA, 1701 nt, Artificial Sequence; identical to SEQ ID NO: 94181
  derived and/or modified sequence opt2 from hemagglutinin__InfluenzaA__ADX96747

SEQ ID NO: 98008 - RNA, 1701 nt, Artificial Sequence
  derived and/or modified sequence opt2 from hemagglutinin__InfluenzaA__ADX96757
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucguccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 98009 - RNA, 1701 nt, Artificial Sequence
  derived and/or modified sequence opt2 from hemagglutinin__InfluenzaA__ADX96767
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgaguccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 98010 - RNA, 1701 nt, Artificial Sequence
  derived and/or modified sequence opt2 from hemagglutinin__InfluenzaA__ADX96777
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucguccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98011 - RNA, 1701 nt, Artificial Sequence; identical to SEQ ID NO: 94181
  derived and/or modified sequence opt2 from hemagglutinin__InfluenzaA__ADX96787

SEQ ID NO: 98012 - RNA, 1701 nt, Artificial Sequence; identical to SEQ ID NO: 97408
  derived and/or modified sequence opt2 from hemagglutinin__InfluenzaA__ADX96797

SEQ ID NO: 98013 - RNA, 1701 nt, Artificial Sequence
  derived and/or modified sequence opt2 from hemagglutinin__InfluenzaA__ADX96807
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuucuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98014 - RNA, 1701 nt, Artificial Sequence; identical to SEQ ID NO: 94168
  derived and/or modified sequence opt2 from hemagglutinin__InfluenzaA__ADX96817

SEQ ID NO: 98015 - RNA, 1701 nt, Artificial Sequence
  derived and/or modified sequence opt2 from hemagglutinin__InfluenzaA__ADX96837
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccuacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaccggcucccuccagugccgcaucugcaucuga

SEQ ID NO: 98016 - RNA, 1701 nt, Artificial Sequence; identical to SEQ ID NO: 94181
  derived and/or modified sequence opt2 from hemagglutinin__InfluenzaA__ADX96847

SEQ ID NO: 98017 - RNA, 1701 nt, Artificial Sequence; identical to SEQ ID NO: 94181
  derived and/or modified sequence opt2 from hemagglutinin__InfluenzaA__ADX96857

SEQ ID NO: 98018 - RNA, 1701 nt, Artificial Sequence; identical to SEQ ID NO: 94361
  derived and/or modified sequence opt2 from hemagglutinin__InfluenzaA__ADX96867

SEQ ID NO: 98019 - RNA, 1701 nt, Artificial Sequence; identical to SEQ ID NO: 97118
  derived and/or modified sequence opt2 from hemagglutinin__InfluenzaA__ADX96877

SEQ ID NO: 98020 - RNA, 1701 nt, Artificial Sequence
  derived and/or modified sequence opt2 from hemagglutinin__InfluenzaA__ADX96897
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98021 - RNA, 1701 nt, Artificial Sequence
  derived and/or modified sequence opt2 from hemagglutinin__InfluenzaA__ADX96907
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacuccggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccuccaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98022 - RNA, 1701 nt, Artificial Sequence
  derived and/or modified sequence opt2 from hemagglutinin__InfluenzaA__ADX96927
augaaggccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggaccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98023 - RNA, 1701 nt, Artificial Sequence; identical to SEQ ID NO: 95601
  derived and/or modified sequence opt2 from hemagglutinin__InfluenzaA__ADX96937

SEQ ID NO: 98024 - RNA, 1701 nt, Artificial Sequence; identical to SEQ ID NO: 94168
  derived and/or modified sequence opt2 from hemagglutinin__InfluenzaA__ADX96947

SEQ ID NO: 98025 - RNA, 1701 nt, Artificial Sequence; identical to SEQ ID NO: 95345
  derived and/or modified sequence opt2 from hemagglutinin__InfluenzaA__ADX96957

SEQ ID NO: 98026 - RNA, 1701 nt, Artificial Sequence; identical to SEQ ID NO: 94494
  derived and/or modified sequence opt2 from hemagglutinin__InfluenzaA__ADX96967

SEQ ID NO: 98027 - RNA, 1701 nt, Artificial Sequence; identical to SEQ ID NO: 94361
  derived and/or modified sequence opt2 from hemagglutinin__InfluenzaA__ADX96977

SEQ ID NO: 98028 - RNA, 1701 nt, Artificial Sequence
  derived and/or modified sequence opt2 from hemagglutinin__InfluenzaA__ADX96987
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98029 - RNA, 1701 nt, Artificial Sequence; identical to SEQ ID NO: 94361
  derived and/or modified sequence opt2 from hemagglutinin__InfluenzaA__ADX96997

SEQ ID NO: 98030 - RNA, 1701 nt, Artificial Sequence
  derived and/or modified sequence opt2 from hemagglutinin__InfluenzaA__ADX97007
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98031 - RNA, 1701 nt, Artificial Sequence; identical to SEQ ID NO: 97980
  derived and/or modified sequence opt2 from hemagglutinin__InfluenzaA__ADX97018

SEQ ID NO: 98032 - RNA, 1701 nt, Artificial Sequence
  derived and/or modified sequence opt2 from hemagglutinin__InfluenzaA__ADX97028
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagcagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 98033 - RNA, 1701 nt, Artificial Sequence; identical to SEQ ID NO: 96734
  derived and/or modified sequence opt2 from hemagglutinin__InfluenzaA__ADX98640

SEQ ID NO: 98034 - RNA, 1701 nt, Artificial Sequence; identical to SEQ ID NO: 95733
  derived and/or modified sequence opt2 from hemagglutinin__InfluenzaA__ADX98650

SEQ ID NO: 98035 - RNA, 1701 nt, Artificial Sequence
  derived and/or modified sequence opt2 from hemagglutinin__InfluenzaA__ADX98665
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 98036 - RNA, 1701 nt, Artificial Sequence; identical to SEQ ID NO: 95345
  derived and/or modified sequence opt2 from hemagglutinin__InfluenzaA__ADX98675

SEQ ID NO: 98037 - RNA, 1701 nt, Artificial Sequence; identical to SEQ ID NO: 95345
  derived and/or modified sequence opt2 from hemagglutinin__InfluenzaA__ADX98695

SEQ ID NO: 98038 - RNA, 1701 nt, Artificial Sequence; identical to SEQ ID NO: 95733
  derived and/or modified sequence opt2 from hemagglutinin__InfluenzaA__ADX98729

SEQ ID NO: 98039 - RNA, 1701 nt, Artificial Sequence; identical to SEQ ID NO: 97064
  derived and/or modified sequence opt2 from hemagglutinin__InfluenzaA__ADX98739

SEQ ID NO: 98040 - RNA, 1701 nt, Artificial Sequence; identical to SEQ ID NO: 96813
  derived and/or modified sequence opt2 from hemagglutinin__InfluenzaA__ADX98748

SEQ ID NO: 98041 - RNA, 1701 nt, Artificial Sequence; identical to SEQ ID NO: 94181
  derived and/or modified sequence opt2 from hemagglutinin__InfluenzaA__ADX98758

SEQ ID NO: 98042 - RNA, 1701 nt, Artificial Sequence; identical to SEQ ID NO: 94534
  derived and/or modified sequence opt2 from hemagglutinin__InfluenzaA__ADX98767

SEQ ID NO: 98043 - RNA, 1701 nt, Artificial Sequence; identical to SEQ ID NO: 95778
  derived and/or modified sequence opt2 from hemagglutinin__InfluenzaA__ADX98777

SEQ ID NO: 98044 - RNA, 1701 nt, Artificial Sequence
  derived and/or modified sequence opt2 from hemagglutinin__InfluenzaA__ADX98785
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucggcggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98045 - RNA, 1701 nt, Artificial Sequence; identical to SEQ ID NO: 95282
  derived and/or modified sequence opt2 from hemagglutinin__InfluenzaA__ADX98792

SEQ ID NO: 98046 - RNA, 1701 nt, Artificial Sequence; identical to SEQ ID NO: 95282
  derived and/or modified sequence opt2 from hemagglutinin__InfluenzaA__ADX98806

SEQ ID NO: 98047 - RNA, 1701 nt, Artificial Sequence; identical to SEQ ID NO: 97222
  derived and/or modified sequence opt2 from hemagglutinin__InfluenzaA__ADX98818

SEQ ID NO: 98048 - RNA, 1701 nt, Artificial Sequence; identical to SEQ ID NO: 94181
  derived and/or modified sequence opt2 from hemagglutinin__InfluenzaA__ADX98828

SEQ ID NO: 98049 - RNA, 1701 nt, Artificial Sequence; identical to SEQ ID NO: 97572
  derived and/or modified sequence opt2 from hemagglutinin__InfluenzaA__ADX98843

SEQ ID NO: 98050 - RNA, 1701 nt, Artificial Sequence
  derived and/or modified sequence opt2 from hemagglutinin__InfluenzaA__ADX98853
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaucgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98051 - RNA, 1701 nt, Artificial Sequence; identical to SEQ ID NO: 95345
  derived and/or modified sequence opt2 from hemagglutinin__InfluenzaA__ADX98860

SEQ ID NO: 98052 - RNA, 1701 nt, Artificial Sequence; identical to SEQ ID NO: 96733
  derived and/or modified sequence opt2 from hemagglutinin__InfluenzaA__ADX98870

SEQ ID NO: 98053 - RNA, 1701 nt, Artificial Sequence
  derived and/or modified sequence opt2 from hemagglutinin__InfluenzaA__ADX98880
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccaucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98054 - RNA, 1701 nt, Artificial Sequence
  derived and/or modified sequence opt2 from hemagglutinin__InfluenzaA__ADX98890
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98055 - RNA, 1701 nt, Artificial Sequence; identical to SEQ ID NO: 95733
  derived and/or modified sequence opt2 from hemagglutinin__InfluenzaA__ADX98900

SEQ ID NO: 98056 - RNA, 1701 nt, Artificial Sequence
  derived and/or modified sequence opt2 from hemagglutinin__InfluenzaA__ADX98910
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaucuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98057 - RNA, 1701 nt, Artificial Sequence; identical to SEQ ID NO: 95733
  derived and/or modified sequence opt2 from hemagglutinin__InfluenzaA__ADX98920

SEQ ID NO: 98058 - RNA, 1701 nt, Artificial Sequence; identical to SEQ ID NO: 95345
  derived and/or modified sequence opt2 from hemagglutinin__InfluenzaA__ADX98930

SEQ ID NO: 98059 - RNA, 1701 nt, Artificial Sequence; identical to SEQ ID NO: 94972
  derived and/or modified sequence opt2 from hemagglutinin__InfluenzaA__ADX98940

SEQ ID NO: 98060 - RNA, 1701 nt, Artificial Sequence; identical to SEQ ID NO: 96801
  derived and/or modified sequence opt2 from hemagglutinin__InfluenzaA__ADX98950

SEQ ID NO: 98061 - RNA, 1701 nt, Artificial Sequence; identical to SEQ ID NO: 96782
  derived and/or modified sequence opt2 from hemagglutinin__InfluenzaA__ADX98960

SEQ ID NO: 98062 - RNA, 1701 nt, Artificial Sequence
  derived and/or modified sequence opt2 from hemagglutinin__InfluenzaA__ADX98970
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98063 - RNA, 1701 nt, Artificial Sequence; identical to SEQ ID NO: 95282
  derived and/or modified sequence opt2 from hemagglutinin__InfluenzaA__ADX98980

SEQ ID NO: 98064 - RNA, 1701 nt, Artificial Sequence; identical to SEQ ID NO: 94181
  derived and/or modified sequence opt2 from hemagglutinin__InfluenzaA__ADX98990

SEQ ID NO: 98065 - RNA, 1701 nt, Artificial Sequence; identical to SEQ ID NO: 95345
  derived and/or modified sequence opt2 from hemagglutinin__InfluenzaA__ADX99000

SEQ ID NO: 98066 - RNA, 1698 nt, Artificial Sequence
  derived and/or modified sequence opt2 from hemagglutinin__InfluenzaA__ADX99581
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98067 - RNA, 1698 nt, Artificial Sequence; identical to SEQ ID NO: 98066
  derived and/or modified sequence opt2 from hemagglutinin__InfluenzaA__ADX99592

SEQ ID NO: 98068 - RNA, 1698 nt, Artificial Sequence; identical to SEQ ID NO: 98066
  derived and/or modified sequence opt2 from hemagglutinin__InfluenzaA__ADX99603

SEQ ID NO: 98069 - RNA, 1698 nt, Artificial Sequence
  derived and/or modified sequence opt2 from hemagglutinin__InfluenzaA__ADX99614
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaagaagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98070 - RNA, 1698 nt, Artificial Sequence
  derived and/or modified sequence opt2 from hemagglutinin__InfluenzaA__ADX99625
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucggcgccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98071 - RNA, 1698 nt, Artificial Sequence
  derived and/or modified sequence opt2 from hemagglutinin__InfluenzaA__ADX99636
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccaagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98072 - RNA, 1698 nt, Artificial Sequence; identical to SEQ ID NO: 94790
  derived and/or modified sequence opt2 from hemagglutinin__InfluenzaA__ADX99647

SEQ ID NO: 98073 - RNA, 1698 nt, Artificial Sequence
  derived and/or modified sequence opt2 from hemagglutinin__InfluenzaA__ADX99680
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccugguccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98074 - RNA, 1698 nt, Artificial Sequence
  derived and/or modified sequence opt2 from hemagglutinin__InfluenzaA__ADX99702
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaaguccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98075 - RNA, 1698 nt, Artificial Sequence; identical to SEQ ID NO: 98074
  derived and/or modified sequence opt2 from hemagglutinin__InfluenzaA__ADX99843

SEQ ID NO: 98076 - RNA, 1698 nt, Artificial Sequence
  derived and/or modified sequence opt2 from hemagglutinin__InfluenzaA__ADX99854
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccucaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98077 - RNA, 1698 nt, Artificial Sequence
  derived and/or modified sequence opt2 from hemagglutinin__InfluenzaA__ADX99865
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcagaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98078 - RNA, 1698 nt, Artificial Sequence
  derived and/or modified sequence opt2 from hemagglutinin__InfluenzaA__ADX99887
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucgagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgcuccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98079 - RNA, 1698 nt, Artificial Sequence
  derived and/or modified sequence opt2 from hemagglutinin__InfluenzaA__ADX99898
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuacuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98080 - RNA, 1698 nt, Artificial Sequence
  derived and/or modified sequence opt2 from hemagglutinin__InfluenzaA__ADX99909
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuucuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98081 - RNA, 1698 nt, Artificial Sequence; identical to SEQ ID NO: 98080
  derived and/or modified sequence opt2 from hemagglutinin__InfluenzaA__ADX99920

SEQ ID NO: 98082 - RNA, 1698 nt, Artificial Sequence
  derived and/or modified sequence opt2 from hemagglutinin__InfluenzaA__ADX99931
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucgagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccggccgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaaccgcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98083 - RNA, 1698 nt, Artificial Sequence
  derived and/or modified sequence opt2 from hemagglutinin__InfluenzaA__ADX99964
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaagcacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98084 - RNA, 1698 nt, Artificial Sequence
  derived and/or modified sequence opt2 from hemagglutinin__InfluenzaA__ADX99975
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccaccugcucccacgagggcaaguccuccuucuaccgcaaccuccucuggcucaccgagaaggagggcuccuaccccgagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98085 - RNA, 1698 nt, Artificial Sequence
  derived and/or modified sequence opt2 from hemagglutinin__InfluenzaA__ADX99986
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccaagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucgagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98086 - RNA, 1698 nt, Artificial Sequence
  derived and/or modified sequence opt2 from hemagglutinin__InfluenzaA__ADX99997
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucgagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaaguacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98087 - RNA, 1698 nt, Artificial Sequence
  derived and/or modified sequence opt2 from hemagglutinin__InfluenzaA__ADY00009
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaagaagggcuccuaccccaagcucgagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 98088 - RNA, 1698 nt, Artificial Sequence; identical to SEQ ID NO: 94790
  derived and/or modified sequence opt2 from hemagglutinin__InfluenzaA__ADY00020

SEQ ID NO: 98089 - RNA, 1698 nt, Artificial Sequence
  derived and/or modified sequence opt2 from hemagglutinin__InfluenzaA__ADY04727
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaaccucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98090 - RNA, 1701 nt, Artificial Sequence; identical to SEQ ID NO: 95125
  derived and/or modified sequence opt2 from hemagglutinin__InfluenzaA__ADY11836

SEQ ID NO: 98091 - RNA, 1701 nt, Artificial Sequence; identical to SEQ ID NO: 95100
  derived and/or modified sequence opt2 from hemagglutinin__InfluenzaA__ADY17654

SEQ ID NO: 98092 - RNA, 1701 nt, Artificial Sequence
  derived and/or modified sequence opt2 from hemagglutinin__InfluenzaA__ADY17665
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98093 - RNA, 1701 nt, Artificial Sequence; identical to SEQ ID NO: 95125
  derived and/or modified sequence opt2 from hemagglutinin__InfluenzaA__ADY17676

SEQ ID NO: 98094 - RNA, 1701 nt, Artificial Sequence
  derived and/or modified sequence opt2 from hemagglutinin__InfluenzaA__ADY17687
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgccgcccuccucggcuucaucaugugggccugccagaagggcaacauccgcugcaacaucugcaucuga

SEQ ID NO: 98095 - RNA, 1701 nt, Artificial Sequence; identical to SEQ ID NO: 95100
  derived and/or modified sequence opt2 from hemagglutinin__InfluenzaA__ADY17698

SEQ ID NO: 98096 - RNA, 1701 nt, Artificial Sequence
  derived and/or modified sequence opt2 from hemagglutinin__InfluenzaA__ADY38719
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98097 - RNA, 1701 nt, Artificial Sequence; identical to SEQ ID NO: 94181
  derived and/or modified sequence opt2 from hemagglutinin__InfluenzaA__ADY38750

SEQ ID NO: 98098 - RNA, 1701 nt, Artificial Sequence; identical to SEQ ID NO: 95345
  derived and/or modified sequence opt2 from hemagglutinin__InfluenzaA__ADY38760

SEQ ID NO: 98099 - RNA, 1701 nt, Artificial Sequence
  derived and/or modified sequence opt2 from hemagglutinin__InfluenzaA__ADZ04607
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 98100 - RNA, 1698 nt, Artificial Sequence; identical to SEQ ID NO: 97475
  derived and/or modified sequence opt2 from hemagglutinin__InfluenzaA__ADZ05834

SEQ ID NO: 98101 - RNA, 1698 nt, Artificial Sequence
  derived and/or modified sequence opt2 from hemagglutinin__InfluenzaA__ADZ05845
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacauggccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98102 - RNA, 1701 nt, Artificial Sequence; identical to SEQ ID NO: 93946
  derived and/or modified sequence opt2 from hemagglutinin__InfluenzaA__ADZ05855

SEQ ID NO: 98103 - RNA, 1701 nt, Artificial Sequence
  derived and/or modified sequence opt2 from hemagglutinin__InfluenzaA__ADZ47838
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccuccuucguccucaucgucucccucggcgccaucuccuucuggaugugcuccaacggcucccuccagugccgcaucugcaucuga

SEQ ID NO: 98104 - RNA, 1701 nt, Artificial Sequence; identical to SEQ ID NO: 95353
  derived and/or modified sequence opt2 from hemagglutinin__InfluenzaA__ADZ47858

SEQ ID NO: 98105 - RNA, 1698 nt, Artificial Sequence
  derived and/or modified sequence opt2 from hemagglutinin__InfluenzaA__ADZ53100
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggagaccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98106 - RNA, 1701 nt, Artificial Sequence; identical to SEQ ID NO: 94628
  derived and/or modified sequence opt2 from hemagglutinin__InfluenzaA__ADZ53123

SEQ ID NO: 98107 - RNA, 1701 nt, Artificial Sequence; identical to SEQ ID NO: 94423
  derived and/or modified sequence opt2 from hemagglutinin__InfluenzaA__ADZ53125

SEQ ID NO: 98108 - RNA, 1701 nt, Artificial Sequence; identical to SEQ ID NO: 94805
  derived and/or modified sequence opt2 from hemagglutinin__InfluenzaA__ADZ53127

SEQ ID NO: 98109 - RNA, 1701 nt, Artificial Sequence; identical to SEQ ID NO: 94168
  derived and/or modified sequence opt2 from hemagglutinin__InfluenzaA__ADZ53131

SEQ ID NO: 98110 - RNA, 1701 nt, Artificial Sequence; identical to SEQ ID NO: 94181
  derived and/or modified sequence opt2 from hemagglutinin__InfluenzaA__ADZ53133

SEQ ID NO: 98111 - RNA, 1701 nt, Artificial Sequence; identical to SEQ ID NO: 94423
  derived and/or modified sequence opt2 from hemagglutinin__InfluenzaA__ADZ53135

SEQ ID NO: 98112 - RNA, 1701 nt, Artificial Sequence; identical to SEQ ID NO: 95345
  derived and/or modified sequence opt2 from hemagglutinin__InfluenzaA__ADZ53138

SEQ ID NO: 98113 - RNA, 1701 nt, Artificial Sequence; identical to SEQ ID NO: 94181
  derived and/or modified sequence opt2 from hemagglutinin__InfluenzaA__ADZ53140

SEQ ID NO: 98114 - RNA, 1701 nt, Artificial Sequence; identical to SEQ ID NO: 94628
  derived and/or modified sequence opt2 from hemagglutinin__InfluenzaA__ADZ93496

SEQ ID NO: 98115 - RNA, 1689 nt, Artificial Sequence; identical to SEQ ID NO: 93862
  derived and/or modified sequence opt2 from hemagglutinin__InfluenzaA__AEA04365

SEQ ID NO: 98116 - RNA, 1689 nt, Artificial Sequence
  derived and/or modified sequence opt2 from hemagglutinin__InfluenzaA__AEA04376
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccgagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaaggucgaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 98117 - RNA, 1698 nt, Artificial Sequence
  derived and/or modified sequence opt2 from hemagglutinin__InfluenzaA__AEA10292
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugcucccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98118 - RNA, 1701 nt, Artificial Sequence; identical to SEQ ID NO: 96780
  derived and/or modified sequence opt2 from hemagglutinin__InfluenzaA__AEA10303

SEQ ID NO: 98119 - RNA, 1701 nt, Artificial Sequence; identical to SEQ ID NO: 97634
  derived and/or modified sequence opt2 from hemagglutinin__InfluenzaA__AEA10313

SEQ ID NO: 98120 - RNA, 1701 nt, Artificial Sequence; identical to SEQ ID NO: 95345
  derived and/or modified sequence opt2 from hemagglutinin__InfluenzaA__AEA10323

SEQ ID NO: 98121 - RNA, 1701 nt, Artificial Sequence; identical to SEQ ID NO: 95733
  derived and/or modified sequence opt2 from hemagglutinin__InfluenzaA__AEA10339

SEQ ID NO: 98122 - RNA, 1701 nt, Artificial Sequence
  derived and/or modified sequence opt2 from hemagglutinin__InfluenzaA__AEA10349
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98123 - RNA, 1701 nt, Artificial Sequence; identical to SEQ ID NO: 95778
  derived and/or modified sequence opt2 from hemagglutinin__InfluenzaA__AEA30293

SEQ ID NO: 98124 - RNA, 1701 nt, Artificial Sequence
  derived and/or modified sequence opt2 from hemagglutinin__InfluenzaA__AEA48989
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgcccgcuccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98125 - RNA, 1707 nt, Artificial Sequence
  derived and/or modified sequence opt2 from hemagglutinin__InfluenzaA__AEA50985
auggagaagaucguccuccuccucgccaucaucaaccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacgacgccuaccccaccaucaagaucuccuacaacaacaccaaccaggaggaccuccucguccucuggggcauccaccaccccaacgacgccgccgagcagaccaagcucuaccagaaccccaccaccuacaucuccgucggcaccuccacccucaaccuccgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccgucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucaacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggagucccgccucaagcgcgaggagaucuccggcgucaagcucgaguccaucggcaucuaccagauccucuccaucuacuccaccgccgccuccucccucgcccucgccaucauggucgccggccucucccucuggaugugcuccaacggcucccuccagugccgcaucugcaucuga

SEQ ID NO: 98126 - RNA, 1701 nt, Artificial Sequence; identical to SEQ ID NO: 97045
  derived and/or modified sequence opt2 from hemagglutinin__InfluenzaA__AEA72704

SEQ ID NO: 98127 - RNA, 1701 nt, Artificial Sequence; identical to SEQ ID NO: 97045
  derived and/or modified sequence opt2 from hemagglutinin__InfluenzaA__AEA72715

SEQ ID NO: 98128 - RNA, 1701 nt, Artificial Sequence; identical to SEQ ID NO: 97045
  derived and/or modified sequence opt2 from hemagglutinin__InfluenzaA__AEA72726

SEQ ID NO: 98129 - RNA, 1701 nt, Artificial Sequence
  derived and/or modified sequence opt2 from hemagglutinin__InfluenzaA__AEA72740
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98130 - RNA, 1701 nt, Artificial Sequence
  derived and/or modified sequence opt2 from hemagglutinin__InfluenzaA__AEA72750
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98131 - RNA, 1701 nt, Artificial Sequence; identical to SEQ ID NO: 97947
  derived and/or modified sequence opt2 from hemagglutinin__InfluenzaA__AEA72759

SEQ ID NO: 98132 - RNA, 1701 nt, Artificial Sequence
  derived and/or modified sequence opt2 from hemagglutinin__InfluenzaA__AEA72777
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacgccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98133 - RNA, 1701 nt, Artificial Sequence; identical to SEQ ID NO: 97947
  derived and/or modified sequence opt2 from hemagglutinin__InfluenzaA__AEA72787

SEQ ID NO: 98134 - RNA, 1701 nt, Artificial Sequence; identical to SEQ ID NO: 97045
  derived and/or modified sequence opt2 from hemagglutinin__InfluenzaA__AEA73288

SEQ ID NO: 98135 - RNA, 1701 nt, Artificial Sequence; identical to SEQ ID NO: 97045
  derived and/or modified sequence opt2 from hemagglutinin__InfluenzaA__AEA73299

SEQ ID NO: 98136 - RNA, 1701 nt, Artificial Sequence; identical to SEQ ID NO: 97045
  derived and/or modified sequence opt2 from hemagglutinin__InfluenzaA__AEA73310

SEQ ID NO: 98137 - RNA, 1701 nt, Artificial Sequence
  derived and/or modified sequence opt2 from hemagglutinin__InfluenzaA__AEA73321
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucacccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98138 - RNA, 1701 nt, Artificial Sequence; identical to SEQ ID NO: 97045
  derived and/or modified sequence opt2 from hemagglutinin__InfluenzaA__AEA73332

SEQ ID NO: 98139 - RNA, 1701 nt, Artificial Sequence; identical to SEQ ID NO: 97045
  derived and/or modified sequence opt2 from hemagglutinin__InfluenzaA__AEA73343

SEQ ID NO: 98140 - RNA, 1701 nt, Artificial Sequence; identical to SEQ ID NO: 97045
  derived and/or modified sequence opt2 from hemagglutinin__InfluenzaA__AEA73354

SEQ ID NO: 98141 - RNA, 1701 nt, Artificial Sequence
  derived and/or modified sequence opt2 from hemagglutinin__InfluenzaA__AEA73365
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98142 - RNA, 1701 nt, Artificial Sequence; identical to SEQ ID NO: 97045
  derived and/or modified sequence opt2 from hemagglutinin__InfluenzaA__AEA73376

SEQ ID NO: 98143 - RNA, 1701 nt, Artificial Sequence; identical to SEQ ID NO: 97045
  derived and/or modified sequence opt2 from hemagglutinin__InfluenzaA__AEA73387

SEQ ID NO: 98144 - RNA, 1701 nt, Artificial Sequence; identical to SEQ ID NO: 97045
  derived and/or modified sequence opt2 from hemagglutinin__InfluenzaA__AEA73398

SEQ ID NO: 98145 - RNA, 1701 nt, Artificial Sequence; identical to SEQ ID NO: 97045
  derived and/or modified sequence opt2 from hemagglutinin__InfluenzaA__AEA73409

SEQ ID NO: 98146 - RNA, 1701 nt, Artificial Sequence; identical to SEQ ID NO: 97045
  derived and/or modified sequence opt2 from hemagglutinin__InfluenzaA__AEA73420

SEQ ID NO: 98147 - RNA, 1701 nt, Artificial Sequence; identical to SEQ ID NO: 97045
  derived and/or modified sequence opt2 from hemagglutinin__InfluenzaA__AEA73452

SEQ ID NO: 98148 - RNA, 1701 nt, Artificial Sequence; identical to SEQ ID NO: 97045
  derived and/or modified sequence opt2 from hemagglutinin__InfluenzaA__AEA73463

SEQ ID NO: 98149 - RNA, 1701 nt, Artificial Sequence; identical to SEQ ID NO: 97045
  derived and/or modified sequence opt2 from hemagglutinin__InfluenzaA__AEA73474

SEQ ID NO: 98150 - RNA, 1701 nt, Artificial Sequence
  derived and/or modified sequence opt2 from hemagglutinin__InfluenzaA__AEA73485
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98151 - RNA, 1701 nt, Artificial Sequence; identical to SEQ ID NO: 97045
  derived and/or modified sequence opt2 from hemagglutinin__InfluenzaA__AEA73496

SEQ ID NO: 98152 - RNA, 1701 nt, Artificial Sequence; identical to SEQ ID NO: 97045
  derived and/or modified sequence opt2 from hemagglutinin__InfluenzaA__AEA73507

SEQ ID NO: 98153 - RNA, 1701 nt, Artificial Sequence; identical to SEQ ID NO: 97045
  derived and/or modified sequence opt2 from hemagglutinin__InfluenzaA__AEA73518

SEQ ID NO: 98154 - RNA, 1701 nt, Artificial Sequence; identical to SEQ ID NO: 97045
  derived and/or modified sequence opt2 from hemagglutinin__InfluenzaA__AEA73529

SEQ ID NO: 98155 - RNA, 1701 nt, Artificial Sequence; identical to SEQ ID NO: 97045
  derived and/or modified sequence opt2 from hemagglutinin__InfluenzaA__AEA73540

SEQ ID NO: 98156 - RNA, 1701 nt, Artificial Sequence; identical to SEQ ID NO: 97045
  derived and/or modified sequence opt2 from hemagglutinin__InfluenzaA__AEA73551

SEQ ID NO: 98157 - RNA, 1701 nt, Artificial Sequence; identical to SEQ ID NO: 97045
  derived and/or modified sequence opt2 from hemagglutinin__InfluenzaA__AEA73562

SEQ ID NO: 98158 - RNA, 1698 nt, Artificial Sequence
  derived and/or modified sequence opt2 from hemagglutinin__InfluenzaA__AEA73573
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98159 - RNA, 1698 nt, Artificial Sequence
  derived and/or modified sequence opt2 from hemagglutinin__InfluenzaA__AEA73584
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98160 - RNA, 1698 nt, Artificial Sequence
  derived and/or modified sequence opt2 from hemagglutinin__InfluenzaA__AEA73595
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98161 - RNA, 1698 nt, Artificial Sequence; identical to SEQ ID NO: 97465
  derived and/or modified sequence opt2 from hemagglutinin__InfluenzaA__AEA73606

SEQ ID NO: 98162 - RNA, 1698 nt, Artificial Sequence; identical to SEQ ID NO: 94643
  derived and/or modified sequence opt2 from hemagglutinin__InfluenzaA__AEA73617

SEQ ID NO: 98163 - RNA, 1698 nt, Artificial Sequence; identical to SEQ ID NO: 95128
  derived and/or modified sequence opt2 from hemagglutinin__InfluenzaA__AEA73628

SEQ ID NO: 98164 - RNA, 1698 nt, Artificial Sequence; identical to SEQ ID NO: 97484
  derived and/or modified sequence opt2 from hemagglutinin__InfluenzaA__AEA73639

SEQ ID NO: 98165 - RNA, 1698 nt, Artificial Sequence; identical to SEQ ID NO: 94643
  derived and/or modified sequence opt2 from hemagglutinin__InfluenzaA__AEA73650

SEQ ID NO: 98166 - RNA, 1698 nt, Artificial Sequence; identical to SEQ ID NO: 95128
  derived and/or modified sequence opt2 from hemagglutinin__InfluenzaA__AEA73661

SEQ ID NO: 98167 - RNA, 1698 nt, Artificial Sequence
  derived and/or modified sequence opt2 from hemagglutinin__InfluenzaA__AEA73672
augaaggucaagcuccucguccuccucugcaccuucaccgccaccuucgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98168 - RNA, 1698 nt, Artificial Sequence; identical to SEQ ID NO: 95128
  derived and/or modified sequence opt2 from hemagglutinin__InfluenzaA__AEA73683

SEQ ID NO: 98169 - RNA, 1698 nt, Artificial Sequence
  derived and/or modified sequence opt2 from hemagglutinin__InfluenzaA__AEA73694
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucgagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98170 - RNA, 1698 nt, Artificial Sequence; identical to SEQ ID NO: 95128
  derived and/or modified sequence opt2 from hemagglutinin__InfluenzaA__AEA73705

SEQ ID NO: 98171 - RNA, 1698 nt, Artificial Sequence; identical to SEQ ID NO: 94643
  derived and/or modified sequence opt2 from hemagglutinin__InfluenzaA__AEA73716

SEQ ID NO: 98172 - RNA, 1698 nt, Artificial Sequence; identical to SEQ ID NO: 94643
  derived and/or modified sequence opt2 from hemagglutinin__InfluenzaA__AEA73727

SEQ ID NO: 98173 - RNA, 1698 nt, Artificial Sequence; identical to SEQ ID NO: 94643
  derived and/or modified sequence opt2 from hemagglutinin__InfluenzaA__AEA73738

SEQ ID NO: 98174 - RNA, 1698 nt, Artificial Sequence; identical to SEQ ID NO: 94643
  derived and/or modified sequence opt2 from hemagglutinin__InfluenzaA__AEA73749

SEQ ID NO: 98175 - RNA, 1698 nt, Artificial Sequence
  derived and/or modified sequence opt2 from hemagglutinin__InfluenzaA__AEA73760
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagauccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98176 - RNA, 1701 nt, Artificial Sequence; identical to SEQ ID NO: 94181
  derived and/or modified sequence opt2 from hemagglutinin__InfluenzaA__AEA73771

SEQ ID NO: 98177 - RNA, 1701 nt, Artificial Sequence; identical to SEQ ID NO: 95811
  derived and/or modified sequence opt2 from hemagglutinin__InfluenzaA__AEA73781

SEQ ID NO: 98178 - RNA, 1701 nt, Artificial Sequence; identical to SEQ ID NO: 95733
  derived and/or modified sequence opt2 from hemagglutinin__InfluenzaA__AEA73791

SEQ ID NO: 98179 - RNA, 1701 nt, Artificial Sequence; identical to SEQ ID NO: 94361
  derived and/or modified sequence opt2 from hemagglutinin__InfluenzaA__AEA73801

SEQ ID NO: 98180 - RNA, 1701 nt, Artificial Sequence; identical to SEQ ID NO: 95345
  derived and/or modified sequence opt2 from hemagglutinin__InfluenzaA__AEA73811

SEQ ID NO: 98181 - RNA, 1701 nt, Artificial Sequence; identical to SEQ ID NO: 95903
  derived and/or modified sequence opt2 from hemagglutinin__InfluenzaA__AEA73821

SEQ ID NO: 98182 - RNA, 1701 nt, Artificial Sequence
  derived and/or modified sequence opt2 from hemagglutinin__InfluenzaA__AEA73831
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98183 - RNA, 1701 nt, Artificial Sequence
  derived and/or modified sequence opt2 from hemagglutinin__InfluenzaA__AEA73841
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucgucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98184 - RNA, 1701 nt, Artificial Sequence; identical to SEQ ID NO: 95811
  derived and/or modified sequence opt2 from hemagglutinin__InfluenzaA__AEA73851

SEQ ID NO: 98185 - RNA, 1701 nt, Artificial Sequence
  derived and/or modified sequence opt2 from hemagglutinin__InfluenzaA__AEA73861
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcgagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98186 - RNA, 1701 nt, Artificial Sequence; identical to SEQ ID NO: 96053
  derived and/or modified sequence opt2 from hemagglutinin__InfluenzaA__AEA73871

SEQ ID NO: 98187 - RNA, 1701 nt, Artificial Sequence; identical to SEQ ID NO: 96053
  derived and/or modified sequence opt2 from hemagglutinin__InfluenzaA__AEA73881

SEQ ID NO: 98188 - RNA, 1701 nt, Artificial Sequence; identical to SEQ ID NO: 95733
  derived and/or modified sequence opt2 from hemagglutinin__InfluenzaA__AEA73891

SEQ ID NO: 98189 - RNA, 1701 nt, Artificial Sequence
  derived and/or modified sequence opt2 from hemagglutinin__InfluenzaA__AEA73901
augaacgccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaagaucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98190 - RNA, 1701 nt, Artificial Sequence; identical to SEQ ID NO: 95345
  derived and/or modified sequence opt2 from hemagglutinin__InfluenzaA__AEA73911

SEQ ID NO: 98191 - RNA, 1701 nt, Artificial Sequence; identical to SEQ ID NO: 96053
  derived and/or modified sequence opt2 from hemagglutinin__InfluenzaA__AEA73921

SEQ ID NO: 98192 - RNA, 1701 nt, Artificial Sequence; identical to SEQ ID NO: 95811
  derived and/or modified sequence opt2 from hemagglutinin__InfluenzaA__AEA73931

SEQ ID NO: 98193 - RNA, 1701 nt, Artificial Sequence; identical to SEQ ID NO: 95811
  derived and/or modified sequence opt2 from hemagglutinin__InfluenzaA__AEA73961

SEQ ID NO: 98194 - RNA, 1701 nt, Artificial Sequence
  derived and/or modified sequence opt2 from hemagglutinin__InfluenzaA__AEA73971
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98195 - RNA, 1701 nt, Artificial Sequence; identical to SEQ ID NO: 95811
  derived and/or modified sequence opt2 from hemagglutinin__InfluenzaA__AEA73981

SEQ ID NO: 98196 - RNA, 1701 nt, Artificial Sequence
  derived and/or modified sequence opt2 from hemagglutinin__InfluenzaA__AEA73991
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacuccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98197 - RNA, 1701 nt, Artificial Sequence; identical to SEQ ID NO: 95794
  derived and/or modified sequence opt2 from hemagglutinin__InfluenzaA__AEA74001

SEQ ID NO: 98198 - RNA, 1701 nt, Artificial Sequence
  derived and/or modified sequence opt2 from hemagglutinin__InfluenzaA__AEA74011
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagcgcaacuccuaccccaagcucucccaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccaucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98199 - RNA, 1701 nt, Artificial Sequence
  derived and/or modified sequence opt2 from hemagglutinin__InfluenzaA__AEA74021
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccaucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98200 - RNA, 1701 nt, Artificial Sequence
  derived and/or modified sequence opt2 from hemagglutinin__InfluenzaA__AEA74031
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaacaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98201 - RNA, 1701 nt, Artificial Sequence
  derived and/or modified sequence opt2 from hemagglutinin__InfluenzaA__AEA74035
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaacaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98202 - RNA, 1701 nt, Artificial Sequence; identical to SEQ ID NO: 93946
  derived and/or modified sequence opt2 from hemagglutinin__InfluenzaA__AEA77299

SEQ ID NO: 98203 - RNA, 1701 nt, Artificial Sequence; identical to SEQ ID NO: 97947
  derived and/or modified sequence opt2 from hemagglutinin__InfluenzaA__AEB21316

SEQ ID NO: 98204 - RNA, 1701 nt, Artificial Sequence; identical to SEQ ID NO: 97966
  derived and/or modified sequence opt2 from hemagglutinin__InfluenzaA__AEB21326

SEQ ID NO: 98205 - RNA, 1701 nt, Artificial Sequence; identical to SEQ ID NO: 97947
  derived and/or modified sequence opt2 from hemagglutinin__InfluenzaA__AEB21338

SEQ ID NO: 98206 - RNA, 1701 nt, Artificial Sequence; identical to SEQ ID NO: 97966
  derived and/or modified sequence opt2 from hemagglutinin__InfluenzaA__AEB21348

SEQ ID NO: 98207 - RNA, 1701 nt, Artificial Sequence; identical to SEQ ID NO: 95100
  derived and/or modified sequence opt2 from hemagglutinin__InfluenzaA__AEB40206

SEQ ID NO: 98208 - RNA, 1701 nt, Artificial Sequence; identical to SEQ ID NO: 95100
  derived and/or modified sequence opt2 from hemagglutinin__InfluenzaA__AEB66895

SEQ ID NO: 98209 - RNA, 1698 nt, Artificial Sequence
  derived and/or modified sequence opt2 from hemagglutinin__InfluenzaA__AEB71102
auggacguccccgucuucguccuccucaugcucaccuccaucugcguccaggccgaccgcaucugcgucggcuaccucuccaccaacuccuccgagcgcgucgacacccuccucgagaacaacguccccgucaccuccuccgucgaccucgucgagaccaaccacaccggcaccuacugcucccucggcggcaucucccccguccaccucggcgacugcuccuucgagggcuggaucgucggcaaccccgccugcgccuccaaccucggcauccgcgagugguccuaccucaucgaggaccccuccgccccccacggccucugcuaccccggcgagcucgacaacaacggcgagcuccgccaccucuucuccggcauccgcuccuucucccgcaccgagcucaucgcccccaccuccuggggcgaggucaacgacggcgucaccgccgccugccaggacaagggcgccuccuccuucuaccgcaaccucgucugguucgucgagcgcggcaacaaguaccccgucauccgccgcaccuacaacaacaccaccggccgcgacguccucgucaucuggggcauccaccaccccgucuccaccgacgaggcccgcaagcucuacgccaaggacaaccccuacacccucgucuccaccuccuccuggucccgcaaguacaaccucgagaccggcacccgccccggcuacaacggccagaaguccuggaccaagaucuacugguaccucaugcaccccggcgacuccaucuccuucgaguccaacggcggccuccucgcccccaaguacggcuacaucaucgaggaguacggcaagggccgcaucuuccagucccgcauccgcaucgccaagugcaacaccaagugccagaccuccgucggcggcaucaacaccaacaagaccuuccagaacaucgagcgcaacgcccucggcgacugccccaaguacaucaaguccggccagcucaagcucgccaccggccuccgcaacguccccgccaucuccaaccgcggccucuucggcgccaucgccggcuucaucgagggcggcuggcccggccucaucaacggcugguacggcuuccagcaccagaacgagcagggcaugggcauggccgccgacaaggaguccacccagaaggccaucgaccagaucaccaccaagaucaacaacaucaucgagaagaugaacggcaacuacgacuccauccgcggcgaguucucccaggucgagcagcgcaucaacaugcucgccgaccgcaucgacgacgccgucaccgacgucugguccuacaacgccaagcuccucguccuccucgagaacgacaagacccucgacaugcacgacgccaacguccgcaaccuccacgaccagguccgccgcguccuccgcaccaacgccaucgacgagggcaacggcugcuucgagcuccuccacaagugcaacgacuccugcauggagaccauccgcaacggcaccuacaaccacaucgaguacgaggaggaguccaagcucaagcgccaggagaucgagggcaucaagcucaaguccgacgacaacgucuacaaggcccucuccaucuacuccugcaucgccuccuccaucguccucgucggccucauccucgccuucaucaugugggccugcuccuccggcaacugccgcuucaacaucugcaucuga

SEQ ID NO: 98210 - RNA, 1698 nt, Artificial Sequence
  derived and/or modified sequence opt2 from hemagglutinin__InfluenzaA__AEB71896
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaacaaggagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98211 - RNA, 1701 nt, Artificial Sequence; identical to SEQ ID NO: 94423
  derived and/or modified sequence opt2 from hemagglutinin__InfluenzaA__AEB71916

SEQ ID NO: 98212 - RNA, 1701 nt, Artificial Sequence; identical to SEQ ID NO: 93946
  derived and/or modified sequence opt2 from hemagglutinin__InfluenzaA__AEB71925

SEQ ID NO: 98213 - RNA, 1701 nt, Artificial Sequence; identical to SEQ ID NO: 93946
  derived and/or modified sequence opt2 from hemagglutinin__InfluenzaA__AEB71936

SEQ ID NO: 98214 - RNA, 1701 nt, Artificial Sequence; identical to SEQ ID NO: 93946
  derived and/or modified sequence opt2 from hemagglutinin__InfluenzaA__AEB71947

SEQ ID NO: 98215 - RNA, 1698 nt, Artificial Sequence; identical to SEQ ID NO: 97484
  derived and/or modified sequence opt2 from hemagglutinin__InfluenzaA__AEB71958

SEQ ID NO: 98216 - RNA, 1701 nt, Artificial Sequence; identical to SEQ ID NO: 96931
  derived and/or modified sequence opt2 from hemagglutinin__InfluenzaA__AEB71969

SEQ ID NO: 98217 - RNA, 1701 nt, Artificial Sequence
  derived and/or modified sequence opt2 from hemagglutinin__InfluenzaA__AEB71980
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98218 - RNA, 1698 nt, Artificial Sequence; identical to SEQ ID NO: 95128
  derived and/or modified sequence opt2 from hemagglutinin__InfluenzaA__AEB71992

SEQ ID NO: 98219 - RNA, 1698 nt, Artificial Sequence; identical to SEQ ID NO: 95128
  derived and/or modified sequence opt2 from hemagglutinin__InfluenzaA__AEC13313

SEQ ID NO: 98220 - RNA, 1701 nt, Artificial Sequence
  derived and/or modified sequence opt2 from hemagglutinin__InfluenzaA__AEC46553
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98221 - RNA, 1701 nt, Artificial Sequence
  derived and/or modified sequence opt2 from hemagglutinin__InfluenzaA__AEC46555
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaagaagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgagggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98222 - RNA, 1701 nt, Artificial Sequence; identical to SEQ ID NO: 98220
  derived and/or modified sequence opt2 from hemagglutinin__InfluenzaA__AEC46557

SEQ ID NO: 98223 - RNA, 1701 nt, Artificial Sequence; identical to SEQ ID NO: 94168
  derived and/or modified sequence opt2 from hemagglutinin__InfluenzaA__AEC53259

SEQ ID NO: 98224 - RNA, 1701 nt, Artificial Sequence
  derived and/or modified sequence opt2 from hemagglutinin__InfluenzaA__AEC53269
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcuccucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98225 - RNA, 1701 nt, Artificial Sequence; identical to SEQ ID NO: 94911
  derived and/or modified sequence opt2 from hemagglutinin__InfluenzaA__AEC53279

SEQ ID NO: 98226 - RNA, 1701 nt, Artificial Sequence; identical to SEQ ID NO: 94168
  derived and/or modified sequence opt2 from hemagglutinin__InfluenzaA__AEC53289

SEQ ID NO: 98227 - RNA, 1701 nt, Artificial Sequence; identical to SEQ ID NO: 94168
  derived and/or modified sequence opt2 from hemagglutinin__InfluenzaA__AEC53299

SEQ ID NO: 98228 - RNA, 1701 nt, Artificial Sequence; identical to SEQ ID NO: 94361
  derived and/or modified sequence opt2 from hemagglutinin__InfluenzaA__AEC53327

SEQ ID NO: 98229 - RNA, 1701 nt, Artificial Sequence
  derived and/or modified sequence opt2 from hemagglutinin__InfluenzaA__AEC53347
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98230 - RNA, 1701 nt, Artificial Sequence
  derived and/or modified sequence opt2 from hemagglutinin__InfluenzaA__AEC53404
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98231 - RNA, 1701 nt, Artificial Sequence; identical to SEQ ID NO: 94168
  derived and/or modified sequence opt2 from hemagglutinin__InfluenzaA__AEC53414

SEQ ID NO: 98232 - RNA, 1701 nt, Artificial Sequence
  derived and/or modified sequence opt2 from hemagglutinin__InfluenzaA__AEE27177
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98233 - RNA, 1701 nt, Artificial Sequence; identical to SEQ ID NO: 95953
  derived and/or modified sequence opt2 from hemagglutinin__InfluenzaA__AEE27187

SEQ ID NO: 98234 - RNA, 1701 nt, Artificial Sequence
  derived and/or modified sequence opt2 from hemagglutinin__InfluenzaA__AEE27207
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaaggucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98235 - RNA, 1701 nt, Artificial Sequence
  derived and/or modified sequence opt2 from hemagglutinin__InfluenzaA__AEG64752
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacguccgcuccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgccgccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98236 - RNA, 1701 nt, Artificial Sequence
  derived and/or modified sequence opt2 from hemagglutinin__InfluenzaA__AEG64762
augaaggcccgccuccucguccuccucugcgcccucgccgccaccgacgccgacaccaucugcaucggcuaccacgccaacaacuccaccgacaccgucgacacccuccucgagaagaacgucaccgucacccacuccgucaaccuccucgaggacucccacaacggcaagcucugcaagcucaagggcaucgccccccuccagcucggcaagugcaacaucgccggcuggcuccucggcaaccccgagugcgacucccuccuccccgcccgcuccugguccuacaucgucgagacccccaacuccgagaacggcgccugcuaccccggcgacuucaucgacuacgaggagcuccgcgagcagcucuccaccgucuccucccucgagcgcuucgagaucuuccccaaggaguccuccuggcccaaccacaacacccucaagggcgucaccgucuccugcucccacggcggcaaguccuccuucuaccgcaaccuccucuggcucaccaagaccggcgacuccuaccccaagcucaacaacuccuacgucaacaacaagggcaaggagguccucguccucuggggcguccaccaccccuccuccuccaacgagcagcagucccucuaccacaacgucaacgccuacgucuccgucgucuccuccaacuacaaccgccgcuucacccccgagaucgccgcccgccccaagguccgcgaccagcccggccgcaugaacuacuacuggacccuccucgagcccggcgacaccauccucuucgaggccaccggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagucccagcucaagaacaacgccaaggagaucggcaacggcugcuucgaguucuaccacaagugcgacaacgagugcauggaguccguccgcgacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98237 - RNA, 1701 nt, Artificial Sequence; identical to SEQ ID NO: 94181
  derived and/or modified sequence opt2 from hemagglutinin__InfluenzaA__AEG64784

SEQ ID NO: 98238 - RNA, 1701 nt, Artificial Sequence
  derived and/or modified sequence opt2 from hemagglutinin__InfluenzaA__AEG64834
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98239 - RNA, 1701 nt, Artificial Sequence
  derived and/or modified sequence opt2 from hemagglutinin__InfluenzaA__AEG64845
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98240 - RNA, 1701 nt, Artificial Sequence
  derived and/or modified sequence opt2 from hemagglutinin__InfluenzaA__AEG64856
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98241 - RNA, 1701 nt, Artificial Sequence; identical to SEQ ID NO: 91584
  derived and/or modified sequence opt2 from hemagglutinin__InfluenzaA__AEG64867

SEQ ID NO: 98242 - RNA, 1701 nt, Artificial Sequence
  derived and/or modified sequence opt2 from hemagglutinin__InfluenzaA__AEG64878
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98243 - RNA, 1701 nt, Artificial Sequence
  derived and/or modified sequence opt2 from hemagglutinin__InfluenzaA__AEG64889
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucuucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98244 - RNA, 1701 nt, Artificial Sequence; identical to SEQ ID NO: 91544
  derived and/or modified sequence opt2 from hemagglutinin__InfluenzaA__AEG64911

SEQ ID NO: 98245 - RNA, 1701 nt, Artificial Sequence; identical to SEQ ID NO: 91544
  derived and/or modified sequence opt2 from hemagglutinin__InfluenzaA__AEG64922

SEQ ID NO: 98246 - RNA, 1701 nt, Artificial Sequence; identical to SEQ ID NO: 91544
  derived and/or modified sequence opt2 from hemagglutinin__InfluenzaA__AEG64933

SEQ ID NO: 98247 - RNA, 1701 nt, Artificial Sequence; identical to SEQ ID NO: 91630
  derived and/or modified sequence opt2 from hemagglutinin__InfluenzaA__AEG64944

SEQ ID NO: 98248 - RNA, 1701 nt, Artificial Sequence; identical to SEQ ID NO: 91544
  derived and/or modified sequence opt2 from hemagglutinin__InfluenzaA__AEG64955

SEQ ID NO: 98249 - RNA, 1701 nt, Artificial Sequence; identical to SEQ ID NO: 91544
  derived and/or modified sequence opt2 from hemagglutinin__InfluenzaA__AEG64966

SEQ ID NO: 98250 - RNA, 1701 nt, Artificial Sequence
  derived and/or modified sequence opt2 from hemagglutinin__InfluenzaA__AEG64977
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98251 - RNA, 1701 nt, Artificial Sequence
  derived and/or modified sequence opt2 from hemagglutinin__InfluenzaA__AEG64988
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacaugccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98252 - RNA, 1701 nt, Artificial Sequence
  derived and/or modified sequence opt2 from hemagglutinin__InfluenzaA__AEG64999
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98253 - RNA, 1701 nt, Artificial Sequence; identical to SEQ ID NO: 91767
  derived and/or modified sequence opt2 from hemagglutinin__InfluenzaA__AEG65010

SEQ ID NO: 98254 - RNA, 1701 nt, Artificial Sequence
  derived and/or modified sequence opt2 from hemagglutinin__InfluenzaA__AEG65021
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaccgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98255 - RNA, 1701 nt, Artificial Sequence
  derived and/or modified sequence opt2 from hemagglutinin__InfluenzaA__AEG65032
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaacaagcucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98256 - RNA, 1701 nt, Artificial Sequence; identical to SEQ ID NO: 92142
  derived and/or modified sequence opt2 from hemagglutinin__InfluenzaA__AEG65043

SEQ ID NO: 98257 - RNA, 1701 nt, Artificial Sequence; identical to SEQ ID NO: 92142
  derived and/or modified sequence opt2 from hemagglutinin__InfluenzaA__AEG65054

SEQ ID NO: 98258 - RNA, 1701 nt, Artificial Sequence
  derived and/or modified sequence opt2 from hemagglutinin__InfluenzaA__AEG65065
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcgucguccuccucggcuucaucaugugggccugccagaagggcaacauccgcugcaacaucugcaucuga

SEQ ID NO: 98259 - RNA, 1701 nt, Artificial Sequence
  derived and/or modified sequence opt2 from hemagglutinin__InfluenzaA__AEG65076
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccuccgcuucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacgucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98260 - RNA, 1701 nt, Artificial Sequence
  derived and/or modified sequence opt2 from hemagglutinin__InfluenzaA__AEG65087
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98261 - RNA, 1701 nt, Artificial Sequence
  derived and/or modified sequence opt2 from hemagglutinin__InfluenzaA__AEG65098
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccacuccaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaaccucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98262 - RNA, 1701 nt, Artificial Sequence
  derived and/or modified sequence opt2 from hemagglutinin__InfluenzaA__AEG65109
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcaagcucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaguccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98263 - RNA, 1701 nt, Artificial Sequence
  derived and/or modified sequence opt2 from hemagglutinin__InfluenzaA__AEG65120
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucgccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98264 - RNA, 1701 nt, Artificial Sequence
  derived and/or modified sequence opt2 from hemagglutinin__InfluenzaA__AEG65131
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccacuccaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98265 - RNA, 1701 nt, Artificial Sequence; identical to SEQ ID NO: 91563
  derived and/or modified sequence opt2 from hemagglutinin__InfluenzaA__AEG65142

SEQ ID NO: 98266 - RNA, 1701 nt, Artificial Sequence; identical to SEQ ID NO: 91563
  derived and/or modified sequence opt2 from hemagglutinin__InfluenzaA__AEG65153

SEQ ID NO: 98267 - RNA, 1701 nt, Artificial Sequence
  derived and/or modified sequence opt2 from hemagglutinin__InfluenzaA__AEG65164
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 98268 - RNA, 1701 nt, Artificial Sequence
  derived and/or modified sequence opt2 from hemagglutinin__InfluenzaA__AEG65175
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 98269 - RNA, 1701 nt, Artificial Sequence; identical to SEQ ID NO: 91931
  derived and/or modified sequence opt2 from hemagglutinin__InfluenzaA__AEG65186

SEQ ID NO: 98270 - RNA, 1701 nt, Artificial Sequence
  derived and/or modified sequence opt2 from hemagglutinin__InfluenzaA__AEG65197
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccucccccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaucauccucaucaacuccaccggcaaccucaucgccccccgcggcuacuucaagauccgcuccggcaaguccuccaucaugcgcuccgacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98271 - RNA, 1701 nt, Artificial Sequence; identical to SEQ ID NO: 92142
  derived and/or modified sequence opt2 from hemagglutinin__InfluenzaA__AEG65208

SEQ ID NO: 98272 - RNA, 1701 nt, Artificial Sequence
  derived and/or modified sequence opt2 from hemagglutinin__InfluenzaA__AEG65219
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 98273 - RNA, 1701 nt, Artificial Sequence; identical to SEQ ID NO: 93307
  derived and/or modified sequence opt2 from hemagglutinin__InfluenzaA__AEG65230

SEQ ID NO: 98274 - RNA, 1701 nt, Artificial Sequence; identical to SEQ ID NO: 93307
  derived and/or modified sequence opt2 from hemagglutinin__InfluenzaA__AEG65252

SEQ ID NO: 98275 - RNA, 1701 nt, Artificial Sequence; identical to SEQ ID NO: 92028
  derived and/or modified sequence opt2 from hemagglutinin__InfluenzaA__AEG65263

SEQ ID NO: 98276 - RNA, 1701 nt, Artificial Sequence; identical to SEQ ID NO: 92028
  derived and/or modified sequence opt2 from hemagglutinin__InfluenzaA__AEG65274

SEQ ID NO: 98277 - RNA, 1701 nt, Artificial Sequence; identical to SEQ ID NO: 92028
  derived and/or modified sequence opt2 from hemagglutinin__InfluenzaA__AEG65285

SEQ ID NO: 98278 - RNA, 1701 nt, Artificial Sequence
  derived and/or modified sequence opt2 from hemagglutinin__InfluenzaA__AEG65296
augaagaccgucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98279 - RNA, 1701 nt, Artificial Sequence; identical to SEQ ID NO: 93307
  derived and/or modified sequence opt2 from hemagglutinin__InfluenzaA__AEG65307

SEQ ID NO: 98280 - RNA, 1701 nt, Artificial Sequence
  derived and/or modified sequence opt2 from hemagglutinin__InfluenzaA__AEG65318
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacguccgccagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98281 - RNA, 1701 nt, Artificial Sequence; identical to SEQ ID NO: 93307
  derived and/or modified sequence opt2 from hemagglutinin__InfluenzaA__AEG65329

SEQ ID NO: 98282 - RNA, 1701 nt, Artificial Sequence
  derived and/or modified sequence opt2 from hemagglutinin__InfluenzaA__AEG65340
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98283 - RNA, 1701 nt, Artificial Sequence; identical to SEQ ID NO: 93307
  derived and/or modified sequence opt2 from hemagglutinin__InfluenzaA__AEG65351

SEQ ID NO: 98284 - RNA, 1701 nt, Artificial Sequence; identical to SEQ ID NO: 93307
  derived and/or modified sequence opt2 from hemagglutinin__InfluenzaA__AEG65362

SEQ ID NO: 98285 - RNA, 1701 nt, Artificial Sequence; identical to SEQ ID NO: 98282
  derived and/or modified sequence opt2 from hemagglutinin__InfluenzaA__AEG65373

SEQ ID NO: 98286 - RNA, 1701 nt, Artificial Sequence; identical to SEQ ID NO: 92028
  derived and/or modified sequence opt2 from hemagglutinin__InfluenzaA__AEG65384

SEQ ID NO: 98287 - RNA, 1701 nt, Artificial Sequence; identical to SEQ ID NO: 92028
  derived and/or modified sequence opt2 from hemagglutinin__InfluenzaA__AEG65406

SEQ ID NO: 98288 - RNA, 1701 nt, Artificial Sequence; identical to SEQ ID NO: 92028
  derived and/or modified sequence opt2 from hemagglutinin__InfluenzaA__AEG65417

SEQ ID NO: 98289 - RNA, 1701 nt, Artificial Sequence; identical to SEQ ID NO: 92028
  derived and/or modified sequence opt2 from hemagglutinin__InfluenzaA__AEG65428

SEQ ID NO: 98290 - RNA, 1701 nt, Artificial Sequence
  derived and/or modified sequence opt2 from hemagglutinin__InfluenzaA__AEG65439
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcgucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98291 - RNA, 1701 nt, Artificial Sequence
  derived and/or modified sequence opt2 from hemagglutinin__InfluenzaA__AEG65450
augaagaccaucaucgccugguccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98292 - RNA, 1701 nt, Artificial Sequence; identical to SEQ ID NO: 98291
  derived and/or modified sequence opt2 from hemagglutinin__InfluenzaA__AEG65461

SEQ ID NO: 98293 - RNA, 1701 nt, Artificial Sequence
  derived and/or modified sequence opt2 from hemagglutinin__InfluenzaA__AEG65472
augaagaccaucaucgccugguccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaucaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98294 - RNA, 1701 nt, Artificial Sequence; identical to SEQ ID NO: 98291
  derived and/or modified sequence opt2 from hemagglutinin__InfluenzaA__AEG65483

SEQ ID NO: 98295 - RNA, 1701 nt, Artificial Sequence; identical to SEQ ID NO: 98291
  derived and/or modified sequence opt2 from hemagglutinin__InfluenzaA__AEG65494

SEQ ID NO: 98296 - RNA, 1701 nt, Artificial Sequence; identical to SEQ ID NO: 98291
  derived and/or modified sequence opt2 from hemagglutinin__InfluenzaA__AEG65505

SEQ ID NO: 98297 - RNA, 1701 nt, Artificial Sequence; identical to SEQ ID NO: 98291
  derived and/or modified sequence opt2 from hemagglutinin__InfluenzaA__AEG65516

SEQ ID NO: 98298 - RNA, 1701 nt, Artificial Sequence; identical to SEQ ID NO: 98291
  derived and/or modified sequence opt2 from hemagglutinin__InfluenzaA__AEG65527

SEQ ID NO: 98299 - RNA, 1701 nt, Artificial Sequence; identical to SEQ ID NO: 98291
  derived and/or modified sequence opt2 from hemagglutinin__InfluenzaA__AEG65538

SEQ ID NO: 98300 - RNA, 1701 nt, Artificial Sequence
  derived and/or modified sequence opt2 from hemagglutinin__InfluenzaA__AEG65560
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98301 - RNA, 1701 nt, Artificial Sequence; identical to SEQ ID NO: 98300
  derived and/or modified sequence opt2 from hemagglutinin__InfluenzaA__AEG65571

SEQ ID NO: 98302 - RNA, 1701 nt, Artificial Sequence; identical to SEQ ID NO: 98300
  derived and/or modified sequence opt2 from hemagglutinin__InfluenzaA__AEG65582

SEQ ID NO: 98303 - RNA, 1701 nt, Artificial Sequence; identical to SEQ ID NO: 98300
  derived and/or modified sequence opt2 from hemagglutinin__InfluenzaA__AEG65593

SEQ ID NO: 98304 - RNA, 1701 nt, Artificial Sequence
  derived and/or modified sequence opt2 from hemagglutinin__InfluenzaA__AEG65604
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggcaagaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98305 - RNA, 1701 nt, Artificial Sequence
  derived and/or modified sequence opt2 from hemagglutinin__InfluenzaA__AEG65626
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaacuccuucuucucccgccucaacuggcucacccaccucaaguucaaguaccccgcccucaacgucaccaugcccaacaacaagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98306 - RNA, 1701 nt, Artificial Sequence
  derived and/or modified sequence opt2 from hemagglutinin__InfluenzaA__AEG65637
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaacuccuucuucucccgccucaacuggcucacccaccucaaguucaaguaccccgcccucaacgucaccaugcccaacaacaagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98307 - RNA, 1701 nt, Artificial Sequence; identical to SEQ ID NO: 91543
  derived and/or modified sequence opt2 from hemagglutinin__InfluenzaA__AEG65648

SEQ ID NO: 98308 - RNA, 1701 nt, Artificial Sequence; identical to SEQ ID NO: 93307
  derived and/or modified sequence opt2 from hemagglutinin__InfluenzaA__AEG65659

SEQ ID NO: 98309 - RNA, 1701 nt, Artificial Sequence; identical to SEQ ID NO: 93307
  derived and/or modified sequence opt2 from hemagglutinin__InfluenzaA__AEG65670

SEQ ID NO: 98310 - RNA, 1701 nt, Artificial Sequence; identical to SEQ ID NO: 93307
  derived and/or modified sequence opt2 from hemagglutinin__InfluenzaA__AEG65681

SEQ ID NO: 98311 - RNA, 1701 nt, Artificial Sequence; identical to SEQ ID NO: 98282
  derived and/or modified sequence opt2 from hemagglutinin__InfluenzaA__AEG65692

SEQ ID NO: 98312 - RNA, 1701 nt, Artificial Sequence; identical to SEQ ID NO: 92142
  derived and/or modified sequence opt2 from hemagglutinin__InfluenzaA__AEG65703

SEQ ID NO: 98313 - RNA, 1701 nt, Artificial Sequence
  derived and/or modified sequence opt2 from hemagglutinin__InfluenzaA__AEG65747
augaagaccaucaucgcccucuccuacauccucugccucgucuucgcccagaagcuccccggcaacgacaacuccaccgccacccucugccucggccaccacaccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98314 - RNA, 1701 nt, Artificial Sequence
  derived and/or modified sequence opt2 from hemagglutinin__InfluenzaA__AEG65758
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98315 - RNA, 1701 nt, Artificial Sequence; identical to SEQ ID NO: 91793
  derived and/or modified sequence opt2 from hemagglutinin__InfluenzaA__AEG65769

SEQ ID NO: 98316 - RNA, 1701 nt, Artificial Sequence
  derived and/or modified sequence opt2 from hemagglutinin__InfluenzaA__AEG65780
augaagaccaucaucgcccucuccuacauccucugccucgucuucgcccagaagcuccccggcaacgacaacuccaccgccacccucugccucggccaccacgccguccccaacggcaccaucgucaagaccaucaccaacgacaagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccgccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98317 - RNA, 1701 nt, Artificial Sequence
  derived and/or modified sequence opt2 from hemagglutinin__InfluenzaA__AEG65813
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaccgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98318 - RNA, 1701 nt, Artificial Sequence
  derived and/or modified sequence opt2 from hemagglutinin__InfluenzaA__AEG79801
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98319 - RNA, 1701 nt, Artificial Sequence
  derived and/or modified sequence opt2 from hemagglutinin__InfluenzaA__AEG79807
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccaccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98320 - RNA, 1701 nt, Artificial Sequence
  derived and/or modified sequence opt2 from hemagglutinin__InfluenzaA__AEG79835
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcaguccaucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98321 - RNA, 1701 nt, Artificial Sequence
  derived and/or modified sequence opt2 from hemagglutinin__InfluenzaA__AEH59363
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98322 - RNA, 1701 nt, Artificial Sequence
  derived and/or modified sequence opt2 from hemagglutinin__InfluenzaA__AEH59367
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacugggcccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98323 - RNA, 1701 nt, Artificial Sequence
  derived and/or modified sequence opt2 from hemagglutinin__InfluenzaA__AEH59369
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98324 - RNA, 1701 nt, Artificial Sequence; identical to SEQ ID NO: 98321
  derived and/or modified sequence opt2 from hemagglutinin__InfluenzaA__AEH59371

SEQ ID NO: 98325 - RNA, 1701 nt, Artificial Sequence
  derived and/or modified sequence opt2 from hemagglutinin__InfluenzaA__AEH59373
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcgaggucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccgccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98326 - RNA, 1701 nt, Artificial Sequence; identical to SEQ ID NO: 98321
  derived and/or modified sequence opt2 from hemagglutinin__InfluenzaA__AEH59375

SEQ ID NO: 98327 - RNA, 1701 nt, Artificial Sequence
  derived and/or modified sequence opt2 from hemagglutinin__InfluenzaA__AEH59379
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98328 - RNA, 1701 nt, Artificial Sequence; identical to SEQ ID NO: 98321
  derived and/or modified sequence opt2 from hemagglutinin__InfluenzaA__AEH59381

SEQ ID NO: 98329 - RNA, 1701 nt, Artificial Sequence
  derived and/or modified sequence opt2 from hemagglutinin__InfluenzaA__AEH59383
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98330 - RNA, 1701 nt, Artificial Sequence
  derived and/or modified sequence opt2 from hemagglutinin__InfluenzaA__AEH59385
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacaucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98331 - RNA, 1701 nt, Artificial Sequence; identical to SEQ ID NO: 98321
  derived and/or modified sequence opt2 from hemagglutinin__InfluenzaA__AEH59387

SEQ ID NO: 98332 - RNA, 1701 nt, Artificial Sequence
  derived and/or modified sequence opt2 from hemagglutinin__InfluenzaA__AEH59393
augaaggccauccucgucgucauccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98333 - RNA, 1701 nt, Artificial Sequence
  derived and/or modified sequence opt2 from hemagglutinin__InfluenzaA__AEH59397
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccucccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucgagaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98334 - RNA, 1701 nt, Artificial Sequence
  derived and/or modified sequence opt2 from hemagglutinin__InfluenzaA__AEH59399
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggaccaucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98335 - RNA, 1701 nt, Artificial Sequence
  derived and/or modified sequence opt2 from hemagglutinin__InfluenzaA__AEH59403
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgcccccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98336 - RNA, 1701 nt, Artificial Sequence
  derived and/or modified sequence opt2 from hemagglutinin__InfluenzaA__AEH59407
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98337 - RNA, 1701 nt, Artificial Sequence; identical to SEQ ID NO: 98336
  derived and/or modified sequence opt2 from hemagglutinin__InfluenzaA__AEH59409

SEQ ID NO: 98338 - RNA, 1701 nt, Artificial Sequence
  derived and/or modified sequence opt2 from hemagglutinin__InfluenzaA__AEH59411
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggaccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98339 - RNA, 1701 nt, Artificial Sequence
  derived and/or modified sequence opt2 from hemagglutinin__InfluenzaA__AEH59413
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98340 - RNA, 1701 nt, Artificial Sequence
  derived and/or modified sequence opt2 from hemagglutinin__InfluenzaA__AEH59585
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgucgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98341 - RNA, 1701 nt, Artificial Sequence
  derived and/or modified sequence opt2 from hemagglutinin__InfluenzaA__AEH59587
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuucauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgucgucggcaaggaguucaacccccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98342 - RNA, 1701 nt, Artificial Sequence; identical to SEQ ID NO: 95345
  derived and/or modified sequence opt2 from hemagglutinin__InfluenzaA__AEH59589

SEQ ID NO: 98343 - RNA, 1701 nt, Artificial Sequence
  derived and/or modified sequence opt2 from hemagglutinin__InfluenzaA__AEH59591
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgucgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98344 - RNA, 1701 nt, Artificial Sequence
  derived and/or modified sequence opt2 from hemagglutinin__InfluenzaA__AEH59593
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98345 - RNA, 1701 nt, Artificial Sequence; identical to SEQ ID NO: 94979
  derived and/or modified sequence opt2 from hemagglutinin__InfluenzaA__AEH59595

SEQ ID NO: 98346 - RNA, 1701 nt, Artificial Sequence; identical to SEQ ID NO: 95345
  derived and/or modified sequence opt2 from hemagglutinin__InfluenzaA__AEH59597

SEQ ID NO: 98347 - RNA, 1701 nt, Artificial Sequence; identical to SEQ ID NO: 98340
  derived and/or modified sequence opt2 from hemagglutinin__InfluenzaA__AEH59599

SEQ ID NO: 98348 - RNA, 1701 nt, Artificial Sequence
  derived and/or modified sequence opt2 from hemagglutinin__InfluenzaA__AEH59601
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaacugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgucgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98349 - RNA, 1701 nt, Artificial Sequence; identical to SEQ ID NO: 94979
  derived and/or modified sequence opt2 from hemagglutinin__InfluenzaA__AEH59604

SEQ ID NO: 98350 - RNA, 1701 nt, Artificial Sequence; identical to SEQ ID NO: 94979
  derived and/or modified sequence opt2 from hemagglutinin__InfluenzaA__AEH59614

SEQ ID NO: 98351 - RNA, 1701 nt, Artificial Sequence
  derived and/or modified sequence opt2 from hemagglutinin__InfluenzaA__AEH59624
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccuucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98352 - RNA, 1698 nt, Artificial Sequence
  derived and/or modified sequence opt2 from hemagglutinin__InfluenzaA__AEH77259
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagauguuccccaaggaguccuccuggcccaaccacaccgucaccggcgucuccgccuccugcucccacaacggcgaguccuccuucuaccgcaaccuccucuggcucaccgagaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucgucuuccucgucucccucggcgccaucuccuucuggaugugcuccaacggcucccuccagugccgcaucugcaucuga

SEQ ID NO: 98353 - RNA, 1701 nt, Artificial Sequence; identical to SEQ ID NO: 94168
  derived and/or modified sequence opt2 from hemagglutinin__InfluenzaA__AEH77270

SEQ ID NO: 98354 - RNA, 1701 nt, Artificial Sequence; identical to SEQ ID NO: 91544
  derived and/or modified sequence opt2 from hemagglutinin__InfluenzaA__AEH77279

SEQ ID NO: 98355 - RNA, 1701 nt, Artificial Sequence; identical to SEQ ID NO: 95283
  derived and/or modified sequence opt2 from hemagglutinin__InfluenzaA__AEI29215

SEQ ID NO: 98356 - RNA, 1701 nt, Artificial Sequence; identical to SEQ ID NO: 94181
  derived and/or modified sequence opt2 from hemagglutinin__InfluenzaA__AEI29225

SEQ ID NO: 98357 - RNA, 1701 nt, Artificial Sequence
  derived and/or modified sequence opt2 from hemagglutinin__InfluenzaA__AEI29591
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccaaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuacaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98358 - RNA, 1701 nt, Artificial Sequence; identical to SEQ ID NO: 91544
  derived and/or modified sequence opt2 from hemagglutinin__InfluenzaA__AEI54347

SEQ ID NO: 98359 - RNA, 1701 nt, Artificial Sequence; identical to SEQ ID NO: 91630
  derived and/or modified sequence opt2 from hemagglutinin__InfluenzaA__AEI54358

SEQ ID NO: 98360 - RNA, 1701 nt, Artificial Sequence; identical to SEQ ID NO: 92145
  derived and/or modified sequence opt2 from hemagglutinin__InfluenzaA__AEI54369

SEQ ID NO: 98361 - RNA, 1701 nt, Artificial Sequence; identical to SEQ ID NO: 92028
  derived and/or modified sequence opt2 from hemagglutinin__InfluenzaA__AEI54380

SEQ ID NO: 98362 - RNA, 1701 nt, Artificial Sequence; identical to SEQ ID NO: 98291
  derived and/or modified sequence opt2 from hemagglutinin__InfluenzaA__AEI54391

SEQ ID NO: 98363 - RNA, 1701 nt, Artificial Sequence
  derived and/or modified sequence opt2 from hemagglutinin__InfluenzaA__AEI54402
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcuacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98364 - RNA, 1701 nt, Artificial Sequence; identical to SEQ ID NO: 93440
  derived and/or modified sequence opt2 from hemagglutinin__InfluenzaA__AEI54413

SEQ ID NO: 98365 - RNA, 1701 nt, Artificial Sequence; identical to SEQ ID NO: 91793
  derived and/or modified sequence opt2 from hemagglutinin__InfluenzaA__AEI54424

SEQ ID NO: 98366 - RNA, 1701 nt, Artificial Sequence
  derived and/or modified sequence opt2 from hemagglutinin__InfluenzaA__AEI54446
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98367 - RNA, 1701 nt, Artificial Sequence
  derived and/or modified sequence opt2 from hemagglutinin__InfluenzaA__AEI54457
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98368 - RNA, 1701 nt, Artificial Sequence; identical to SEQ ID NO: 97045
  derived and/or modified sequence opt2 from hemagglutinin__InfluenzaA__AEI54468

SEQ ID NO: 98369 - RNA, 1701 nt, Artificial Sequence; identical to SEQ ID NO: 97045
  derived and/or modified sequence opt2 from hemagglutinin__InfluenzaA__AEI54479

SEQ ID NO: 98370 - RNA, 1701 nt, Artificial Sequence; identical to SEQ ID NO: 98367
  derived and/or modified sequence opt2 from hemagglutinin__InfluenzaA__AEI54490

SEQ ID NO: 98371 - RNA, 1701 nt, Artificial Sequence; identical to SEQ ID NO: 98366
  derived and/or modified sequence opt2 from hemagglutinin__InfluenzaA__AEI54501

SEQ ID NO: 98372 - RNA, 1701 nt, Artificial Sequence
  derived and/or modified sequence opt2 from hemagglutinin__InfluenzaA__AEI59979
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98373 - RNA, 1698 nt, Artificial Sequence; identical to SEQ ID NO: 97469
  derived and/or modified sequence opt2 from hemagglutinin__InfluenzaA__AEI59990

SEQ ID NO: 98374 - RNA, 1698 nt, Artificial Sequence; identical to SEQ ID NO: 97471
  derived and/or modified sequence opt2 from hemagglutinin__InfluenzaA__AEI60001

SEQ ID NO: 98375 - RNA, 1701 nt, Artificial Sequence
  derived and/or modified sequence opt2 from hemagglutinin__InfluenzaA__AEI60012
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcuccuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggcaagauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98376 - RNA, 1701 nt, Artificial Sequence; identical to SEQ ID NO: 93946
  derived and/or modified sequence opt2 from hemagglutinin__InfluenzaA__AEI60023

SEQ ID NO: 98377 - RNA, 1701 nt, Artificial Sequence
  derived and/or modified sequence opt2 from hemagglutinin__InfluenzaA__AEI60034
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98378 - RNA, 1701 nt, Artificial Sequence
  derived and/or modified sequence opt2 from hemagglutinin__InfluenzaA__AEI60045
augaagaccaucaucgcccucuccuacauccucugccucgucuucgcccagaagcuccccggcaacgacaacuccaccgccacccucugccucggccaccacgccguccccaacggcaccaucgucaagaccaucaugaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcuaccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98379 - RNA, 1701 nt, Artificial Sequence
  derived and/or modified sequence opt2 from hemagglutinin__InfluenzaA__AEI60086
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98380 - RNA, 1701 nt, Artificial Sequence
  derived and/or modified sequence opt2 from hemagglutinin__InfluenzaA__AEI60109
augaagaccaccaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacaacguccccgacuacgucucccuccgcucccucgucgccuccuccggcacccucgaguucaacaacgaguccuucaacuggaccggcgucgcccaggacggcuccuccuacgccugcaagcgccgcuccaacaaguccuucuucucccgccucaacuggcuccaccagcucaacuacaaguaccccgcccucaacgucaccaugcccaacaacgagaacuucgacaagcucuacaucuggggcguccaccaccccggcaccgacuccgaccagaucucccucuacgcccaggccuccggccgcgucaccgucuccaccaagcgcucccagcagaccgucauccccaacaucggcuaccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggcaccggccaggccgccgacaucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccacaucaagggcgucgagcucaaguccggcuacaaggacuggauccucuggaucuccuucgccaccuccugcuuccuccucugcaucguccuccucggcuucaucaugugggccugccagaagggcaacauccgcugcaacaucugcaucuga

SEQ ID NO: 98381 - RNA, 1701 nt, Artificial Sequence
  derived and/or modified sequence opt2 from hemagglutinin__InfluenzaA__AEI86734
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuaccgcaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98382 - RNA, 1701 nt, Artificial Sequence
  derived and/or modified sequence opt2 from hemagglutinin__InfluenzaA__AEI86764
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98383 - RNA, 1701 nt, Artificial Sequence; identical to SEQ ID NO: 98382
  derived and/or modified sequence opt2 from hemagglutinin__InfluenzaA__AEI86774

SEQ ID NO: 98384 - RNA, 1701 nt, Artificial Sequence
  derived and/or modified sequence opt2 from hemagglutinin__InfluenzaA__AEI86784
augaaggucauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98385 - RNA, 1701 nt, Artificial Sequence
  derived and/or modified sequence opt2 from hemagglutinin__InfluenzaA__AEI86794
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98386 - RNA, 1701 nt, Artificial Sequence
  derived and/or modified sequence opt2 from hemagglutinin__InfluenzaA__AEI86804
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucauguggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccgccgucgccuccucccucguccucgucgucucccucggcgccaucuccuucuggaugugcuccaacggcucccuccagugccgcaucugcaucuga

SEQ ID NO: 98387 - RNA, 1701 nt, Artificial Sequence; identical to SEQ ID NO: 98382
  derived and/or modified sequence opt2 from hemagglutinin__InfluenzaA__AEI86814

SEQ ID NO: 98388 - RNA, 1701 nt, Artificial Sequence
  derived and/or modified sequence opt2 from hemagglutinin__InfluenzaA__AEI86824
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccaggacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98389 - RNA, 1701 nt, Artificial Sequence
  derived and/or modified sequence opt2 from hemagglutinin__InfluenzaA__AEI86834
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacucccgcaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98390 - RNA, 1701 nt, Artificial Sequence; identical to SEQ ID NO: 97096
  derived and/or modified sequence opt2 from hemagglutinin__InfluenzaA__AEI86854

SEQ ID NO: 98391 - RNA, 1701 nt, Artificial Sequence
  derived and/or modified sequence opt2 from hemagglutinin__InfluenzaA__AEI86864
augaaggccauccucgucgcccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98392 - RNA, 1701 nt, Artificial Sequence; identical to SEQ ID NO: 98382
  derived and/or modified sequence opt2 from hemagglutinin__InfluenzaA__AEI86874

SEQ ID NO: 98393 - RNA, 1701 nt, Artificial Sequence
  derived and/or modified sequence opt2 from hemagglutinin__InfluenzaA__AEI86894
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98394 - RNA, 1701 nt, Artificial Sequence
  derived and/or modified sequence opt2 from hemagglutinin__InfluenzaA__AEI86904
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98395 - RNA, 1701 nt, Artificial Sequence
  derived and/or modified sequence opt2 from hemagglutinin__InfluenzaA__AEI86914
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuacccccgccucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98396 - RNA, 1701 nt, Artificial Sequence
  derived and/or modified sequence opt2 from hemagglutinin__InfluenzaA__AEI86924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccguccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98397 - RNA, 1701 nt, Artificial Sequence; identical to SEQ ID NO: 98382
  derived and/or modified sequence opt2 from hemagglutinin__InfluenzaA__AEI86934

SEQ ID NO: 98398 - RNA, 1701 nt, Artificial Sequence; identical to SEQ ID NO: 97096
  derived and/or modified sequence opt2 from hemagglutinin__InfluenzaA__AEI86944

SEQ ID NO: 98399 - RNA, 1701 nt, Artificial Sequence
  derived and/or modified sequence opt2 from hemagglutinin__InfluenzaA__AEI86964
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccguccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98400 - RNA, 1701 nt, Artificial Sequence; identical to SEQ ID NO: 97338
  derived and/or modified sequence opt2 from hemagglutinin__InfluenzaA__AEI86974

SEQ ID NO: 98401 - RNA, 1701 nt, Artificial Sequence; identical to SEQ ID NO: 97096
  derived and/or modified sequence opt2 from hemagglutinin__InfluenzaA__AEI86984

SEQ ID NO: 98402 - RNA, 1701 nt, Artificial Sequence; identical to SEQ ID NO: 97096
  derived and/or modified sequence opt2 from hemagglutinin__InfluenzaA__AEI86994

SEQ ID NO: 98403 - RNA, 1701 nt, Artificial Sequence
  derived and/or modified sequence opt2 from hemagglutinin__InfluenzaA__AEI87004
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98404 - RNA, 1701 nt, Artificial Sequence
  derived and/or modified sequence opt2 from hemagglutinin__InfluenzaA__AEI87014
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccggcgaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98405 - RNA, 1701 nt, Artificial Sequence
  derived and/or modified sequence opt2 from hemagglutinin__InfluenzaA__AEI87034
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccaucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98406 - RNA, 1701 nt, Artificial Sequence; identical to SEQ ID NO: 97096
  derived and/or modified sequence opt2 from hemagglutinin__InfluenzaA__AEI87044

SEQ ID NO: 98407 - RNA, 1701 nt, Artificial Sequence; identical to SEQ ID NO: 95345
  derived and/or modified sequence opt2 from hemagglutinin__InfluenzaA__AEI87054

SEQ ID NO: 98408 - RNA, 1701 nt, Artificial Sequence
  derived and/or modified sequence opt2 from hemagglutinin__InfluenzaA__AEI87064
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 98409 - RNA, 1701 nt, Artificial Sequence
  derived and/or modified sequence opt2 from hemagglutinin__InfluenzaA__AEI87074
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98410 - RNA, 1701 nt, Artificial Sequence
  derived and/or modified sequence opt2 from hemagglutinin__InfluenzaA__AEI87094
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98411 - RNA, 1701 nt, Artificial Sequence; identical to SEQ ID NO: 98410
  derived and/or modified sequence opt2 from hemagglutinin__InfluenzaA__AEI87104

SEQ ID NO: 98412 - RNA, 1698 nt, Artificial Sequence; identical to SEQ ID NO: 95138
  derived and/or modified sequence opt2 from hemagglutinin__InfluenzaA__AEI91963

SEQ ID NO: 98413 - RNA, 1701 nt, Artificial Sequence; identical to SEQ ID NO: 95345
  derived and/or modified sequence opt2 from hemagglutinin__InfluenzaA__AEI91977

SEQ ID NO: 98414 - RNA, 1701 nt, Artificial Sequence; identical to SEQ ID NO: 96869
  derived and/or modified sequence opt2 from hemagglutinin__InfluenzaA__AEI91978

SEQ ID NO: 98415 - RNA, 1701 nt, Artificial Sequence; identical to SEQ ID NO: 95811
  derived and/or modified sequence opt2 from hemagglutinin__InfluenzaA__AEI91998

SEQ ID NO: 98416 - RNA, 1701 nt, Artificial Sequence
  derived and/or modified sequence opt2 from hemagglutinin__InfluenzaA__AEI91999
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccucaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98417 - RNA, 1698 nt, Artificial Sequence
  derived and/or modified sequence opt2 from hemagglutinin__InfluenzaA__AEI92018
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98418 - RNA, 1701 nt, Artificial Sequence; identical to SEQ ID NO: 98393
  derived and/or modified sequence opt2 from hemagglutinin__InfluenzaA__AEJ10400

SEQ ID NO: 98419 - RNA, 1701 nt, Artificial Sequence
  derived and/or modified sequence opt2 from hemagglutinin__InfluenzaA__AEJ10410
augaagaccauccucgucguccuccucuacaccuucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccugguccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98420 - RNA, 1701 nt, Artificial Sequence
  derived and/or modified sequence opt2 from hemagglutinin__InfluenzaA__AEJ10420
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98421 - RNA, 1701 nt, Artificial Sequence
  derived and/or modified sequence opt2 from hemagglutinin__InfluenzaA__AEJ10430
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98422 - RNA, 1701 nt, Artificial Sequence
  derived and/or modified sequence opt2 from hemagglutinin__InfluenzaA__AEJ10440
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagauccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98423 - RNA, 1701 nt, Artificial Sequence; identical to SEQ ID NO: 98336
  derived and/or modified sequence opt2 from hemagglutinin__InfluenzaA__AEJ10450

SEQ ID NO: 98424 - RNA, 1701 nt, Artificial Sequence
  derived and/or modified sequence opt2 from hemagglutinin__InfluenzaA__AEJ10480
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccaguccgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98425 - RNA, 1701 nt, Artificial Sequence
  derived and/or modified sequence opt2 from hemagglutinin__InfluenzaA__AEJ10490
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucaucgucucccucggcgccaucuccuucuggaugugcuccaacggcucccuccagugccgcaucugcaucuga

SEQ ID NO: 98426 - RNA, 1701 nt, Artificial Sequence
  derived and/or modified sequence opt2 from hemagglutinin__InfluenzaA__AEJ10500
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucaacaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98427 - RNA, 1701 nt, Artificial Sequence; identical to SEQ ID NO: 98379
  derived and/or modified sequence opt2 from hemagglutinin__InfluenzaA__AEJ10510

SEQ ID NO: 98428 - RNA, 1701 nt, Artificial Sequence
  derived and/or modified sequence opt2 from hemagglutinin__InfluenzaA__AEJ10520
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaacuacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugcuccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98429 - RNA, 1701 nt, Artificial Sequence; identical to SEQ ID NO: 94181
  derived and/or modified sequence opt2 from hemagglutinin__InfluenzaA__AEJ10530

SEQ ID NO: 98430 - RNA, 1701 nt, Artificial Sequence; identical to SEQ ID NO: 94181
  derived and/or modified sequence opt2 from hemagglutinin__InfluenzaA__AEJ10540

SEQ ID NO: 98431 - RNA, 1701 nt, Artificial Sequence; identical to SEQ ID NO: 94181
  derived and/or modified sequence opt2 from hemagglutinin__InfluenzaA__AEJ10550

SEQ ID NO: 98432 - RNA, 1701 nt, Artificial Sequence
  derived and/or modified sequence opt2 from hemagglutinin__InfluenzaA__AEJ10570
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacgccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98433 - RNA, 1701 nt, Artificial Sequence; identical to SEQ ID NO: 98432
  derived and/or modified sequence opt2 from hemagglutinin__InfluenzaA__AEJ10580

SEQ ID NO: 98434 - RNA, 1701 nt, Artificial Sequence
  derived and/or modified sequence opt2 from hemagglutinin__InfluenzaA__AEJ36302
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccuacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagcgccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98435 - RNA, 1701 nt, Artificial Sequence
  derived and/or modified sequence opt2 from hemagglutinin__InfluenzaA__AEJ36312
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98436 - RNA, 1701 nt, Artificial Sequence
  derived and/or modified sequence opt2 from hemagglutinin__InfluenzaA__AEJ37853
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgaggccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98437 - RNA, 1701 nt, Artificial Sequence
  derived and/or modified sequence opt2 from hemagglutinin__InfluenzaA__AEJ37863
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagcuccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98438 - RNA, 1701 nt, Artificial Sequence; identical to SEQ ID NO: 95345
  derived and/or modified sequence opt2 from hemagglutinin__InfluenzaA__AEJ37873

SEQ ID NO: 98439 - RNA, 1701 nt, Artificial Sequence; identical to SEQ ID NO: 98393
  derived and/or modified sequence opt2 from hemagglutinin__InfluenzaA__AEJ37883

SEQ ID NO: 98440 - RNA, 1701 nt, Artificial Sequence
  derived and/or modified sequence opt2 from hemagglutinin__InfluenzaA__AEJ37893
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacaagcccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98441 - RNA, 1701 nt, Artificial Sequence; identical to SEQ ID NO: 98393
  derived and/or modified sequence opt2 from hemagglutinin__InfluenzaA__AEJ37903

SEQ ID NO: 98442 - RNA, 1701 nt, Artificial Sequence
  derived and/or modified sequence opt2 from hemagglutinin__InfluenzaA__AEJ37923
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccaucgagcgcauggccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98443 - RNA, 1701 nt, Artificial Sequence
  derived and/or modified sequence opt2 from hemagglutinin__InfluenzaA__AEJ37943
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98444 - RNA, 1701 nt, Artificial Sequence; identical to SEQ ID NO: 98393
  derived and/or modified sequence opt2 from hemagglutinin__InfluenzaA__AEJ37953

SEQ ID NO: 98445 - RNA, 1701 nt, Artificial Sequence
  derived and/or modified sequence opt2 from hemagglutinin__InfluenzaA__AEJ37963
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaccaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98446 - RNA, 1701 nt, Artificial Sequence; identical to SEQ ID NO: 95345
  derived and/or modified sequence opt2 from hemagglutinin__InfluenzaA__AEJ37973

SEQ ID NO: 98447 - RNA, 1701 nt, Artificial Sequence; identical to SEQ ID NO: 98393
  derived and/or modified sequence opt2 from hemagglutinin__InfluenzaA__AEJ37983

SEQ ID NO: 98448 - RNA, 1701 nt, Artificial Sequence; identical to SEQ ID NO: 97045
  derived and/or modified sequence opt2 from hemagglutinin__InfluenzaA__AEK21369

SEQ ID NO: 98449 - RNA, 1698 nt, Artificial Sequence; identical to SEQ ID NO: 95128
  derived and/or modified sequence opt2 from hemagglutinin__InfluenzaA__AEK21380

SEQ ID NO: 98450 - RNA, 1701 nt, Artificial Sequence
  derived and/or modified sequence opt2 from hemagglutinin__InfluenzaA__AEK21396
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgagauggagcgcaaguccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98451 - RNA, 1701 nt, Artificial Sequence
  derived and/or modified sequence opt2 from hemagglutinin__InfluenzaA__AEK21406
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccauguccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98452 - RNA, 1701 nt, Artificial Sequence
  derived and/or modified sequence opt2 from hemagglutinin__InfluenzaA__AEK21416
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccguccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98453 - RNA, 1701 nt, Artificial Sequence
  derived and/or modified sequence opt2 from hemagglutinin__InfluenzaA__AEK21426
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacguccgcuccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98454 - RNA, 1701 nt, Artificial Sequence; identical to SEQ ID NO: 95345
  derived and/or modified sequence opt2 from hemagglutinin__InfluenzaA__AEK21436

SEQ ID NO: 98455 - RNA, 1701 nt, Artificial Sequence
  derived and/or modified sequence opt2 from hemagglutinin__InfluenzaA__AEK21456
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggagaacgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98456 - RNA, 1701 nt, Artificial Sequence; identical to SEQ ID NO: 98393
  derived and/or modified sequence opt2 from hemagglutinin__InfluenzaA__AEK21466

SEQ ID NO: 98457 - RNA, 1701 nt, Artificial Sequence; identical to SEQ ID NO: 98393
  derived and/or modified sequence opt2 from hemagglutinin__InfluenzaA__AEK21476

SEQ ID NO: 98458 - RNA, 1701 nt, Artificial Sequence; identical to SEQ ID NO: 95345
  derived and/or modified sequence opt2 from hemagglutinin__InfluenzaA__AEK21486

SEQ ID NO: 98459 - RNA, 1701 nt, Artificial Sequence
  derived and/or modified sequence opt2 from hemagglutinin__InfluenzaA__AEK28774
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98460 - RNA, 1701 nt, Artificial Sequence
  derived and/or modified sequence opt2 from hemagglutinin__InfluenzaA__AEK28785
augaagaccaucaucgcccucuccuacauccucugccucgucuucgcccagaaccuccccggcaacgacaacuccgccgccacccucugccucggccaccacgccguccccaacggcaccaucgucaagaccaucaccaacgaccaggucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98461 - RNA, 1701 nt, Artificial Sequence
  derived and/or modified sequence opt2 from hemagglutinin__InfluenzaA__AEK28796
augaagaccaucaucgcccucuccuacauccucugccucgucuucgcccagaagcuccccggcaacgacaacuccaccgccacccucugccucggccaccacgccguccccaacggcaccaucgucaagaccaucaccaacgacaagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgcggcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98462 - RNA, 1701 nt, Artificial Sequence
  derived and/or modified sequence opt2 from hemagglutinin__InfluenzaA__AEK28807
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacggcaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98463 - RNA, 1701 nt, Artificial Sequence
  derived and/or modified sequence opt2 from hemagglutinin__InfluenzaA__AEK28818
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacaacaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98464 - RNA, 1701 nt, Artificial Sequence
  derived and/or modified sequence opt2 from hemagglutinin__InfluenzaA__AEK28828
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggucugccagaagggcaacauccgcugcaacaucugcaucuga

SEQ ID NO: 98465 - RNA, 1701 nt, Artificial Sequence; identical to SEQ ID NO: 93946
  derived and/or modified sequence opt2 from hemagglutinin__InfluenzaA__AEK28839

SEQ ID NO: 98466 - RNA, 1701 nt, Artificial Sequence
  derived and/or modified sequence opt2 from hemagglutinin__InfluenzaA__AEK28850
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgccuccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98467 - RNA, 1701 nt, Artificial Sequence
  derived and/or modified sequence opt2 from hemagglutinin__InfluenzaA__AEK28861
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcucaaggagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 98468 - RNA, 1701 nt, Artificial Sequence
  derived and/or modified sequence opt2 from hemagglutinin__InfluenzaA__AEK28872
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98469 - RNA, 1701 nt, Artificial Sequence
  derived and/or modified sequence opt2 from hemagglutinin__InfluenzaA__AEK28883
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccuccaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98470 - RNA, 1701 nt, Artificial Sequence
  derived and/or modified sequence opt2 from hemagglutinin__InfluenzaA__AEK28894
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98471 - RNA, 1701 nt, Artificial Sequence
  derived and/or modified sequence opt2 from hemagglutinin__InfluenzaA__AEK28905
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98472 - RNA, 1701 nt, Artificial Sequence
  derived and/or modified sequence opt2 from hemagglutinin__InfluenzaA__AEK28916
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98473 - RNA, 1701 nt, Artificial Sequence
  derived and/or modified sequence opt2 from hemagglutinin__InfluenzaA__AEK28927
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98474 - RNA, 1701 nt, Artificial Sequence
  derived and/or modified sequence opt2 from hemagglutinin__InfluenzaA__AEK28949
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugccucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98475 - RNA, 1701 nt, Artificial Sequence; identical to SEQ ID NO: 93946
  derived and/or modified sequence opt2 from hemagglutinin__InfluenzaA__AEK28960

SEQ ID NO: 98476 - RNA, 1701 nt, Artificial Sequence; identical to SEQ ID NO: 93946
  derived and/or modified sequence opt2 from hemagglutinin__InfluenzaA__AEK28971

SEQ ID NO: 98477 - RNA, 1701 nt, Artificial Sequence
  derived and/or modified sequence opt2 from hemagglutinin__InfluenzaA__AEK28982
augaagaccaucaucgcccucuccuacauccucugccucgucuucgcccagaagcuccccggcaacuacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98478 - RNA, 1701 nt, Artificial Sequence
  derived and/or modified sequence opt2 from hemagglutinin__InfluenzaA__AEK28993
augaagaccaucaucgcccucuccuacauccucugccucgucuucgcccagaagcuccccggcaacuacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98479 - RNA, 1701 nt, Artificial Sequence
  derived and/or modified sequence opt2 from hemagglutinin__InfluenzaA__AEK29004
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98480 - RNA, 1701 nt, Artificial Sequence
  derived and/or modified sequence opt2 from hemagglutinin__InfluenzaA__AEK29026
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccaggacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguacuccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagaugcaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98481 - RNA, 1701 nt, Artificial Sequence
  derived and/or modified sequence opt2 from hemagglutinin__InfluenzaA__AEK29048
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucgcccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98482 - RNA, 1701 nt, Artificial Sequence
  derived and/or modified sequence opt2 from hemagglutinin__InfluenzaA__AEK29070
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98483 - RNA, 1701 nt, Artificial Sequence
  derived and/or modified sequence opt2 from hemagglutinin__InfluenzaA__AEK29081
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccauccaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98484 - RNA, 1701 nt, Artificial Sequence; identical to SEQ ID NO: 97045
  derived and/or modified sequence opt2 from hemagglutinin__InfluenzaA__AEK29092

SEQ ID NO: 98485 - RNA, 1701 nt, Artificial Sequence; identical to SEQ ID NO: 98367
  derived and/or modified sequence opt2 from hemagglutinin__InfluenzaA__AEK29125

SEQ ID NO: 98486 - RNA, 1701 nt, Artificial Sequence; identical to SEQ ID NO: 98367
  derived and/or modified sequence opt2 from hemagglutinin__InfluenzaA__AEK29136

SEQ ID NO: 98487 - RNA, 1701 nt, Artificial Sequence; identical to SEQ ID NO: 98367
  derived and/or modified sequence opt2 from hemagglutinin__InfluenzaA__AEK29169

SEQ ID NO: 98488 - RNA, 1701 nt, Artificial Sequence; identical to SEQ ID NO: 98367
  derived and/or modified sequence opt2 from hemagglutinin__InfluenzaA__AEK29180

SEQ ID NO: 98489 - RNA, 1701 nt, Artificial Sequence; identical to SEQ ID NO: 98367
  derived and/or modified sequence opt2 from hemagglutinin__InfluenzaA__AEK29191

SEQ ID NO: 98490 - RNA, 1701 nt, Artificial Sequence; identical to SEQ ID NO: 98367
  derived and/or modified sequence opt2 from hemagglutinin__InfluenzaA__AEK29202

SEQ ID NO: 98491 - RNA, 1701 nt, Artificial Sequence; identical to SEQ ID NO: 98367
  derived and/or modified sequence opt2 from hemagglutinin__InfluenzaA__AEK29213

SEQ ID NO: 98492 - RNA, 1701 nt, Artificial Sequence; identical to SEQ ID NO: 98367
  derived and/or modified sequence opt2 from hemagglutinin__InfluenzaA__AEK29224

SEQ ID NO: 98493 - RNA, 1701 nt, Artificial Sequence; identical to SEQ ID NO: 98367
  derived and/or modified sequence opt2 from hemagglutinin__InfluenzaA__AEK29235

SEQ ID NO: 98494 - RNA, 1701 nt, Artificial Sequence
  derived and/or modified sequence opt2 from hemagglutinin__InfluenzaA__AEK29268
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98495 - RNA, 1698 nt, Artificial Sequence
  derived and/or modified sequence opt2 from hemagglutinin__InfluenzaA__AEK59838
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccgaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacuccaagaaguucacccccgagaucgccaagcgccccaagguccgcgaccaggagggccgcaucaacuacuacuggacccuccucgagcccggcaacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98496 - RNA, 1701 nt, Artificial Sequence
  derived and/or modified sequence opt2 from hemagglutinin__InfluenzaA__AEK98378
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98497 - RNA, 1701 nt, Artificial Sequence; identical to SEQ ID NO: 93427
  derived and/or modified sequence opt2 from hemagglutinin__InfluenzaA__AEK98380

SEQ ID NO: 98498 - RNA, 1701 nt, Artificial Sequence
  derived and/or modified sequence opt2 from hemagglutinin__InfluenzaA__AEK98382
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccagaucggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98499 - RNA, 1701 nt, Artificial Sequence
  derived and/or modified sequence opt2 from hemagglutinin__InfluenzaA__AEK98386
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcacccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98500 - RNA, 1701 nt, Artificial Sequence
  derived and/or modified sequence opt2 from hemagglutinin__InfluenzaA__AEK98388
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98501 - RNA, 1701 nt, Artificial Sequence
  derived and/or modified sequence opt2 from hemagglutinin__InfluenzaA__AEK98390
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgccugcaucacccccaacggcuccauccccaacgacaagaccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98502 - RNA, 1701 nt, Artificial Sequence
  derived and/or modified sequence opt2 from hemagglutinin__InfluenzaA__AEK98392
augaagaccaucaucgcccucuccuacauccucugccucgucuucgcccagaagcuccccggcaacgacaacuccaccgccacccucugccucggccaccacgccguccccaacggcaccaucgucaagaccaucaccgacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgccuccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98503 - RNA, 1701 nt, Artificial Sequence
  derived and/or modified sequence opt2 from hemagglutinin__InfluenzaA__AEK98394
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgccuccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98504 - RNA, 1701 nt, Artificial Sequence
  derived and/or modified sequence opt2 from hemagglutinin__InfluenzaA__AEK98396
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaaguccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 98505 - RNA, 1701 nt, Artificial Sequence
  derived and/or modified sequence opt2 from hemagglutinin__InfluenzaA__AEK98398
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggaucaucuggaucuccuucgccaucuccugcuuccuccucugcgucgcccuccucggcuucaucaugugggccugccagaagggcaacauccgcugcaacaucugcaucuga

SEQ ID NO: 98506 - RNA, 1701 nt, Artificial Sequence
  derived and/or modified sequence opt2 from hemagglutinin__InfluenzaA__AEK98400
auggagaccaucaucgcccucuccuacauccucucccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98507 - RNA, 1701 nt, Artificial Sequence
  derived and/or modified sequence opt2 from hemagglutinin__InfluenzaA__AEK98402
augaagaccaucaucgcccucuccuacauccucugccucggcuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98508 - RNA, 1701 nt, Artificial Sequence
  derived and/or modified sequence opt2 from hemagglutinin__InfluenzaA__AEK98404
augaagaccaucaucgcccucuccuacauccucucccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagaugcgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 98509 - RNA, 1701 nt, Artificial Sequence
  derived and/or modified sequence opt2 from hemagglutinin__InfluenzaA__AEK98406
augaagaccaucaucgcccucuccuacauccucucccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgaggagcucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucgucaugugggccugccagaagggcaacauccgcugcaacaucugcaucuga

SEQ ID NO: 98510 - RNA, 1701 nt, Artificial Sequence
  derived and/or modified sequence opt2 from hemagglutinin__InfluenzaA__AEL11687
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagauccgccucuacgcccaggccuccggccgcaucaccgucuccaccaagcgcucccagcagaccgucauccccaacaucggcuaccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98511 - RNA, 1692 nt, Artificial Sequence
  derived and/or modified sequence opt2 from hemagglutinin__InfluenzaA__AEL31632
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccggcgucuccuccgucugccccuaccagggccgcuccuccuucuuccgcaacgucgucuggcucaccaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 98512 - RNA, 1701 nt, Artificial Sequence; identical to SEQ ID NO: 98432
  derived and/or modified sequence opt2 from hemagglutinin__InfluenzaA__AEL89297

SEQ ID NO: 98513 - RNA, 1701 nt, Artificial Sequence; identical to SEQ ID NO: 98432
  derived and/or modified sequence opt2 from hemagglutinin__InfluenzaA__AEL89307

SEQ ID NO: 98514 - RNA, 1701 nt, Artificial Sequence; identical to SEQ ID NO: 98432
  derived and/or modified sequence opt2 from hemagglutinin__InfluenzaA__AEL89317

SEQ ID NO: 98515 - RNA, 1701 nt, Artificial Sequence; identical to SEQ ID NO: 98432
  derived and/or modified sequence opt2 from hemagglutinin__InfluenzaA__AEL89327

SEQ ID NO: 98516 - RNA, 1701 nt, Artificial Sequence; identical to SEQ ID NO: 98432
  derived and/or modified sequence opt2 from hemagglutinin__InfluenzaA__AEL89337

SEQ ID NO: 98517 - RNA, 1701 nt, Artificial Sequence; identical to SEQ ID NO: 98432
  derived and/or modified sequence opt2 from hemagglutinin__InfluenzaA__AEL89347

SEQ ID NO: 98518 - RNA, 1701 nt, Artificial Sequence; identical to SEQ ID NO: 98432
  derived and/or modified sequence opt2 from hemagglutinin__InfluenzaA__AEL89357

SEQ ID NO: 98519 - RNA, 1701 nt, Artificial Sequence; identical to SEQ ID NO: 98432
  derived and/or modified sequence opt2 from hemagglutinin__InfluenzaA__AEL89367

SEQ ID NO: 98520 - RNA, 1701 nt, Artificial Sequence; identical to SEQ ID NO: 98432
  derived and/or modified sequence opt2 from hemagglutinin__InfluenzaA__AEL89391

SEQ ID NO: 98521 - RNA, 1701 nt, Artificial Sequence; identical to SEQ ID NO: 98432
  derived and/or modified sequence opt2 from hemagglutinin__InfluenzaA__AEL89401

SEQ ID NO: 98522 - RNA, 1701 nt, Artificial Sequence; identical to SEQ ID NO: 98432
  derived and/or modified sequence opt2 from hemagglutinin__InfluenzaA__AEL89411

SEQ ID NO: 98523 - RNA, 1701 nt, Artificial Sequence; identical to SEQ ID NO: 98432
  derived and/or modified sequence opt2 from hemagglutinin__InfluenzaA__AEL89421

SEQ ID NO: 98524 - RNA, 1701 nt, Artificial Sequence; identical to SEQ ID NO: 98432
  derived and/or modified sequence opt2 from hemagglutinin__InfluenzaA__AEL89441

SEQ ID NO: 98525 - RNA, 1701 nt, Artificial Sequence; identical to SEQ ID NO: 98432
  derived and/or modified sequence opt2 from hemagglutinin__InfluenzaA__AEL89451

SEQ ID NO: 98526 - RNA, 1701 nt, Artificial Sequence; identical to SEQ ID NO: 98432
  derived and/or modified sequence opt2 from hemagglutinin__InfluenzaA__AEL89461

SEQ ID NO: 98527 - RNA, 1701 nt, Artificial Sequence; identical to SEQ ID NO: 98432
  derived and/or modified sequence opt2 from hemagglutinin__InfluenzaA__AEL89471

SEQ ID NO: 98528 - RNA, 1701 nt, Artificial Sequence
  derived and/or modified sequence opt2 from hemagglutinin__InfluenzaA__AEL89481
augaaggucauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98529 - RNA, 1701 nt, Artificial Sequence; identical to SEQ ID NO: 97096
  derived and/or modified sequence opt2 from hemagglutinin__InfluenzaA__AEL89491

SEQ ID NO: 98530 - RNA, 1701 nt, Artificial Sequence
  derived and/or modified sequence opt2 from hemagglutinin__InfluenzaA__AEL89501
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacgagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98531 - RNA, 1701 nt, Artificial Sequence; identical to SEQ ID NO: 95345
  derived and/or modified sequence opt2 from hemagglutinin__InfluenzaA__AEL89511

SEQ ID NO: 98532 - RNA, 1701 nt, Artificial Sequence; identical to SEQ ID NO: 97096
  derived and/or modified sequence opt2 from hemagglutinin__InfluenzaA__AEL89521

SEQ ID NO: 98533 - RNA, 1701 nt, Artificial Sequence
  derived and/or modified sequence opt2 from hemagglutinin__InfluenzaA__AEL89531
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98534 - RNA, 1701 nt, Artificial Sequence; identical to SEQ ID NO: 97096
  derived and/or modified sequence opt2 from hemagglutinin__InfluenzaA__AEL89541

SEQ ID NO: 98535 - RNA, 1701 nt, Artificial Sequence
  derived and/or modified sequence opt2 from hemagglutinin__InfluenzaA__AEL89551
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98536 - RNA, 1701 nt, Artificial Sequence
  derived and/or modified sequence opt2 from hemagglutinin__InfluenzaA__AEL89561
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccgagaucuaccagauccucgccaucuacuccaccgucgccuccucccucguccucgucgucucccucggcgccaucuccuucuggaugugcuccaacggcucccuccagugccgcaucugcaucuga

SEQ ID NO: 98537 - RNA, 1701 nt, Artificial Sequence; identical to SEQ ID NO: 97096
  derived and/or modified sequence opt2 from hemagglutinin__InfluenzaA__AEL89571

SEQ ID NO: 98538 - RNA, 1701 nt, Artificial Sequence
  derived and/or modified sequence opt2 from hemagglutinin__InfluenzaA__AEL89581
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98539 - RNA, 1701 nt, Artificial Sequence; identical to SEQ ID NO: 97966
  derived and/or modified sequence opt2 from hemagglutinin__InfluenzaA__AEL89591

SEQ ID NO: 98540 - RNA, 1701 nt, Artificial Sequence
  derived and/or modified sequence opt2 from hemagglutinin__InfluenzaA__AEL89601
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaaggucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98541 - RNA, 1701 nt, Artificial Sequence; identical to SEQ ID NO: 97966
  derived and/or modified sequence opt2 from hemagglutinin__InfluenzaA__AEL89611

SEQ ID NO: 98542 - RNA, 1701 nt, Artificial Sequence; identical to SEQ ID NO: 98408
  derived and/or modified sequence opt2 from hemagglutinin__InfluenzaA__AEL89621

SEQ ID NO: 98543 - RNA, 1701 nt, Artificial Sequence; identical to SEQ ID NO: 97096
  derived and/or modified sequence opt2 from hemagglutinin__InfluenzaA__AEL89631

SEQ ID NO: 98544 - RNA, 1701 nt, Artificial Sequence; identical to SEQ ID NO: 98432
  derived and/or modified sequence opt2 from hemagglutinin__InfluenzaA__AEL89641

SEQ ID NO: 98545 - RNA, 1701 nt, Artificial Sequence
  derived and/or modified sequence opt2 from hemagglutinin__InfluenzaA__AEL89651
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguucgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98546 - RNA, 1701 nt, Artificial Sequence; identical to SEQ ID NO: 97947
  derived and/or modified sequence opt2 from hemagglutinin__InfluenzaA__AEL89661

SEQ ID NO: 98547 - RNA, 1701 nt, Artificial Sequence
  derived and/or modified sequence opt2 from hemagglutinin__InfluenzaA__AEL89671
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccaguccgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98548 - RNA, 1701 nt, Artificial Sequence; identical to SEQ ID NO: 97947
  derived and/or modified sequence opt2 from hemagglutinin__InfluenzaA__AEL89691

SEQ ID NO: 98549 - RNA, 1701 nt, Artificial Sequence
  derived and/or modified sequence opt2 from hemagglutinin__InfluenzaA__AEL89701
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagaaccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucgucgucucccucggcgccaucuccuucuggaugugcuccaacggcucccuccagugccgcaucugcaucuga

SEQ ID NO: 98550 - RNA, 1701 nt, Artificial Sequence; identical to SEQ ID NO: 98549
  derived and/or modified sequence opt2 from hemagglutinin__InfluenzaA__AEL89711

SEQ ID NO: 98551 - RNA, 1701 nt, Artificial Sequence; identical to SEQ ID NO: 97947
  derived and/or modified sequence opt2 from hemagglutinin__InfluenzaA__AEL89721

SEQ ID NO: 98552 - RNA, 1701 nt, Artificial Sequence
  derived and/or modified sequence opt2 from hemagglutinin__InfluenzaA__AEL89741
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98553 - RNA, 1701 nt, Artificial Sequence; identical to SEQ ID NO: 97096
  derived and/or modified sequence opt2 from hemagglutinin__InfluenzaA__AEL89751

SEQ ID NO: 98554 - RNA, 1701 nt, Artificial Sequence
  derived and/or modified sequence opt2 from hemagglutinin__InfluenzaA__AEL89761
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucgucgucucccucggcgccaucuccuucuggaugugcuccaacggcucccuccagugccgcaucugcaucuga

SEQ ID NO: 98555 - RNA, 1701 nt, Artificial Sequence; identical to SEQ ID NO: 98432
  derived and/or modified sequence opt2 from hemagglutinin__InfluenzaA__AEL89771

SEQ ID NO: 98556 - RNA, 1701 nt, Artificial Sequence; identical to SEQ ID NO: 98554
  derived and/or modified sequence opt2 from hemagglutinin__InfluenzaA__AEL89781

SEQ ID NO: 98557 - RNA, 1701 nt, Artificial Sequence; identical to SEQ ID NO: 97947
  derived and/or modified sequence opt2 from hemagglutinin__InfluenzaA__AEL89791

SEQ ID NO: 98558 - RNA, 1701 nt, Artificial Sequence
  derived and/or modified sequence opt2 from hemagglutinin__InfluenzaA__AEL89801
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccguccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 98559 - RNA, 1701 nt, Artificial Sequence
  derived and/or modified sequence opt2 from hemagglutinin__InfluenzaA__AEL89812
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacgccaccugccagacccccaagggcgucaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucgucgucucccucggcgccaucuccuucuggaugugcuccaacggcucccuccagugccgcaucugcaucuga

SEQ ID NO: 98560 - RNA, 1701 nt, Artificial Sequence; identical to SEQ ID NO: 97947
  derived and/or modified sequence opt2 from hemagglutinin__InfluenzaA__AEL89832

SEQ ID NO: 98561 - RNA, 1701 nt, Artificial Sequence
  derived and/or modified sequence opt2 from hemagglutinin__InfluenzaA__AEL89842
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacgccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98562 - RNA, 1701 nt, Artificial Sequence
  derived and/or modified sequence opt2 from hemagglutinin__InfluenzaA__AEL89852
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98563 - RNA, 1701 nt, Artificial Sequence; identical to SEQ ID NO: 97966
  derived and/or modified sequence opt2 from hemagglutinin__InfluenzaA__AEL93568

SEQ ID NO: 98564 - RNA, 1701 nt, Artificial Sequence; identical to SEQ ID NO: 97947
  derived and/or modified sequence opt2 from hemagglutinin__InfluenzaA__AEL93578

SEQ ID NO: 98565 - RNA, 1701 nt, Artificial Sequence
  derived and/or modified sequence opt2 from hemagglutinin__InfluenzaA__AEL93598
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgucuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98566 - RNA, 1701 nt, Artificial Sequence
  derived and/or modified sequence opt2 from hemagglutinin__InfluenzaA__AEL93618
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98567 - RNA, 1701 nt, Artificial Sequence; identical to SEQ ID NO: 97947
  derived and/or modified sequence opt2 from hemagglutinin__InfluenzaA__AEL93628

SEQ ID NO: 98568 - RNA, 1701 nt, Artificial Sequence; identical to SEQ ID NO: 98382
  derived and/or modified sequence opt2 from hemagglutinin__InfluenzaA__AEL93638

SEQ ID NO: 98569 - RNA, 1701 nt, Artificial Sequence
  derived and/or modified sequence opt2 from hemagglutinin__InfluenzaA__AEL94870
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucaagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98570 - RNA, 1701 nt, Artificial Sequence
  derived and/or modified sequence opt2 from hemagglutinin__InfluenzaA__AEL95426
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98571 - RNA, 1701 nt, Artificial Sequence
  derived and/or modified sequence opt2 from hemagglutinin__InfluenzaA__AEL97631
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaccaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98572 - RNA, 1701 nt, Artificial Sequence
  derived and/or modified sequence opt2 from hemagglutinin__InfluenzaA__AEL99664
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98573 - RNA, 1701 nt, Artificial Sequence
  derived and/or modified sequence opt2 from hemagglutinin__InfluenzaA__AEL99674
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaucuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98574 - RNA, 1689 nt, Artificial Sequence; identical to SEQ ID NO: 97783
  derived and/or modified sequence opt2 from hemagglutinin__InfluenzaA__AEM53455

SEQ ID NO: 98575 - RNA, 1689 nt, Artificial Sequence; identical to SEQ ID NO: 93132
  derived and/or modified sequence opt2 from hemagglutinin__InfluenzaA__AEM53468

SEQ ID NO: 98576 - RNA, 1698 nt, Artificial Sequence; identical to SEQ ID NO: 93627
  derived and/or modified sequence opt2 from hemagglutinin__InfluenzaA__AEM60037

SEQ ID NO: 98577 - RNA, 1698 nt, Artificial Sequence
  derived and/or modified sequence opt2 from hemagglutinin__InfluenzaA__AEM60058
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggagucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggacguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucggccgcggcuucggcuccggcaucaucaccuccaacgcccccauggacaagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 98578 - RNA, 1701 nt, Artificial Sequence
  derived and/or modified sequence opt2 from hemagglutinin__InfluenzaA__AEM60069
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 98579 - RNA, 1701 nt, Artificial Sequence
  derived and/or modified sequence opt2 from hemagglutinin__InfluenzaA__AEM92308
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagcgcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccgagaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 98580 - RNA, 1701 nt, Artificial Sequence
  derived and/or modified sequence opt2 from hemagglutinin__InfluenzaA__AEM92318
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98581 - RNA, 1701 nt, Artificial Sequence
  derived and/or modified sequence opt2 from hemagglutinin__InfluenzaA__AEM92328
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaucuccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98582 - RNA, 1701 nt, Artificial Sequence
  derived and/or modified sequence opt2 from hemagglutinin__InfluenzaA__AEM92348
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98583 - RNA, 1701 nt, Artificial Sequence
  derived and/or modified sequence opt2 from hemagglutinin__InfluenzaA__AEM92358
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagaugcgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98584 - RNA, 1701 nt, Artificial Sequence
  derived and/or modified sequence opt2 from hemagglutinin__InfluenzaA__AEM92368
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98585 - RNA, 1701 nt, Artificial Sequence
  derived and/or modified sequence opt2 from hemagglutinin__InfluenzaA__AEM92378
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucaacuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98586 - RNA, 1701 nt, Artificial Sequence
  derived and/or modified sequence opt2 from hemagglutinin__InfluenzaA__AEM92407
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucaccaucgagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggacccacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaugggcucccuccagugccgcaucugcaucuga

SEQ ID NO: 98587 - RNA, 1701 nt, Artificial Sequence
  derived and/or modified sequence opt2 from hemagglutinin__InfluenzaA__AEM92417
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98588 - RNA, 1701 nt, Artificial Sequence
  derived and/or modified sequence opt2 from hemagglutinin__InfluenzaA__AEM92428
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98589 - RNA, 1701 nt, Artificial Sequence
  derived and/or modified sequence opt2 from hemagglutinin__InfluenzaA__AEM92438
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98590 - RNA, 1701 nt, Artificial Sequence; identical to SEQ ID NO: 98321
  derived and/or modified sequence opt2 from hemagglutinin__InfluenzaA__AEM92448

SEQ ID NO: 98591 - RNA, 1701 nt, Artificial Sequence; identical to SEQ ID NO: 98321
  derived and/or modified sequence opt2 from hemagglutinin__InfluenzaA__AEM92458

SEQ ID NO: 98592 - RNA, 1701 nt, Artificial Sequence
  derived and/or modified sequence opt2 from hemagglutinin__InfluenzaA__AEM92468
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaaggaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaucugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98593 - RNA, 1701 nt, Artificial Sequence
  derived and/or modified sequence opt2 from hemagglutinin__InfluenzaA__AEM92478
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaucugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98594 - RNA, 1701 nt, Artificial Sequence
  derived and/or modified sequence opt2 from hemagglutinin__InfluenzaA__AEM92498
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98595 - RNA, 1701 nt, Artificial Sequence
  derived and/or modified sequence opt2 from hemagglutinin__InfluenzaA__AEM92518
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacgccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaaggucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98596 - RNA, 1701 nt, Artificial Sequence
  derived and/or modified sequence opt2 from hemagglutinin__InfluenzaA__AEM92528
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggccuucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98597 - RNA, 1701 nt, Artificial Sequence
  derived and/or modified sequence opt2 from hemagglutinin__InfluenzaA__AEM92548
augaaggccauccucgucguccuccucuacaccuucgccaccgccaccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98598 - RNA, 1701 nt, Artificial Sequence
  derived and/or modified sequence opt2 from hemagglutinin__InfluenzaA__AEM92558
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcuccaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98599 - RNA, 1701 nt, Artificial Sequence; identical to SEQ ID NO: 98598
  derived and/or modified sequence opt2 from hemagglutinin__InfluenzaA__AEM92568

SEQ ID NO: 98600 - RNA, 1701 nt, Artificial Sequence
  derived and/or modified sequence opt2 from hemagglutinin__InfluenzaA__AEM92578
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98601 - RNA, 1701 nt, Artificial Sequence
  derived and/or modified sequence opt2 from hemagglutinin__InfluenzaA__AEM92608
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98602 - RNA, 1701 nt, Artificial Sequence
  derived and/or modified sequence opt2 from hemagglutinin__InfluenzaA__AEM92618
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaccggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacucccgcaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98603 - RNA, 1701 nt, Artificial Sequence
  derived and/or modified sequence opt2 from hemagglutinin__InfluenzaA__AEM92638
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacaccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 98604 - RNA, 1701 nt, Artificial Sequence
  derived and/or modified sequence opt2 from hemagglutinin__InfluenzaA__AEM92648
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacaccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 98605 - RNA, 1701 nt, Artificial Sequence; identical to SEQ ID NO: 97045
  derived and/or modified sequence opt2 from hemagglutinin__InfluenzaA__AEM98407

SEQ ID NO: 98606 - RNA, 1701 nt, Artificial Sequence; identical to SEQ ID NO: 97045
  derived and/or modified sequence opt2 from hemagglutinin__InfluenzaA__AEM98418

SEQ ID NO: 98607 - RNA, 1701 nt, Artificial Sequence; identical to SEQ ID NO: 97045
  derived and/or modified sequence opt2 from hemagglutinin__InfluenzaA__AEM98429

SEQ ID NO: 98608 - RNA, 1701 nt, Artificial Sequence
  derived and/or modified sequence opt2 from hemagglutinin__InfluenzaA__AEN55398
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgucaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98609 - RNA, 1701 nt, Artificial Sequence; identical to SEQ ID NO: 98432
  derived and/or modified sequence opt2 from hemagglutinin__InfluenzaA__AEN55408

SEQ ID NO: 98610 - RNA, 1701 nt, Artificial Sequence; identical to SEQ ID NO: 97947
  derived and/or modified sequence opt2 from hemagglutinin__InfluenzaA__AEN55418

SEQ ID NO: 98611 - RNA, 1701 nt, Artificial Sequence; identical to SEQ ID NO: 97096
  derived and/or modified sequence opt2 from hemagglutinin__InfluenzaA__AEN55463

SEQ ID NO: 98612 - RNA, 1701 nt, Artificial Sequence
  derived and/or modified sequence opt2 from hemagglutinin__InfluenzaA__AEN55473
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccaccgaccagcagucccucuaccagaccgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98613 - RNA, 1701 nt, Artificial Sequence; identical to SEQ ID NO: 97947
  derived and/or modified sequence opt2 from hemagglutinin__InfluenzaA__AEN55483

SEQ ID NO: 98614 - RNA, 1701 nt, Artificial Sequence; identical to SEQ ID NO: 98554
  derived and/or modified sequence opt2 from hemagglutinin__InfluenzaA__AEN55493

SEQ ID NO: 98615 - RNA, 1701 nt, Artificial Sequence; identical to SEQ ID NO: 97947
  derived and/or modified sequence opt2 from hemagglutinin__InfluenzaA__AEN55503

SEQ ID NO: 98616 - RNA, 1701 nt, Artificial Sequence
  derived and/or modified sequence opt2 from hemagglutinin__InfluenzaA__AEN55513
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagaaccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98617 - RNA, 1701 nt, Artificial Sequence; identical to SEQ ID NO: 97947
  derived and/or modified sequence opt2 from hemagglutinin__InfluenzaA__AEN55523

SEQ ID NO: 98618 - RNA, 1701 nt, Artificial Sequence; identical to SEQ ID NO: 96736
  derived and/or modified sequence opt2 from hemagglutinin__InfluenzaA__AEN68904

SEQ ID NO: 98619 - RNA, 1701 nt, Artificial Sequence; identical to SEQ ID NO: 94181
  derived and/or modified sequence opt2 from hemagglutinin__InfluenzaA__AEN68905

SEQ ID NO: 98620 - RNA, 1701 nt, Artificial Sequence; identical to SEQ ID NO: 94181
  derived and/or modified sequence opt2 from hemagglutinin__InfluenzaA__AEN68906

SEQ ID NO: 98621 - RNA, 1701 nt, Artificial Sequence; identical to SEQ ID NO: 95283
  derived and/or modified sequence opt2 from hemagglutinin__InfluenzaA__AEN68907

SEQ ID NO: 98622 - RNA, 1701 nt, Artificial Sequence; identical to SEQ ID NO: 94181
  derived and/or modified sequence opt2 from hemagglutinin__InfluenzaA__AEN68908

SEQ ID NO: 98623 - RNA, 1701 nt, Artificial Sequence
  derived and/or modified sequence opt2 from hemagglutinin__InfluenzaA__AEN68909
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98624 - RNA, 1701 nt, Artificial Sequence
  derived and/or modified sequence opt2 from hemagglutinin__InfluenzaA__AEN68910
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaagggcaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98625 - RNA, 1701 nt, Artificial Sequence; identical to SEQ ID NO: 96297
  derived and/or modified sequence opt2 from hemagglutinin__InfluenzaA__AEN68911

SEQ ID NO: 98626 - RNA, 1701 nt, Artificial Sequence; identical to SEQ ID NO: 94181
  derived and/or modified sequence opt2 from hemagglutinin__InfluenzaA__AEN68912

SEQ ID NO: 98627 - RNA, 1701 nt, Artificial Sequence; identical to SEQ ID NO: 94272
  derived and/or modified sequence opt2 from hemagglutinin__InfluenzaA__AEN68913

SEQ ID NO: 98628 - RNA, 1701 nt, Artificial Sequence; identical to SEQ ID NO: 96847
  derived and/or modified sequence opt2 from hemagglutinin__InfluenzaA__AEN68914

SEQ ID NO: 98629 - RNA, 1701 nt, Artificial Sequence; identical to SEQ ID NO: 94181
  derived and/or modified sequence opt2 from hemagglutinin__InfluenzaA__AEN68915

SEQ ID NO: 98630 - RNA, 1701 nt, Artificial Sequence; identical to SEQ ID NO: 94181
  derived and/or modified sequence opt2 from hemagglutinin__InfluenzaA__AEN68916

SEQ ID NO: 98631 - RNA, 1701 nt, Artificial Sequence
  derived and/or modified sequence opt2 from hemagglutinin__InfluenzaA__AEN68917
augaaggccauccucggcguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccgucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98632 - RNA, 1701 nt, Artificial Sequence
  derived and/or modified sequence opt2 from hemagglutinin__InfluenzaA__AEN68918
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagaacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98633 - RNA, 1701 nt, Artificial Sequence; identical to SEQ ID NO: 97096
  derived and/or modified sequence opt2 from hemagglutinin__InfluenzaA__AEN68919

SEQ ID NO: 98634 - RNA, 1701 nt, Artificial Sequence; identical to SEQ ID NO: 96345
  derived and/or modified sequence opt2 from hemagglutinin__InfluenzaA__AEN68920

SEQ ID NO: 98635 - RNA, 1701 nt, Artificial Sequence; identical to SEQ ID NO: 95345
  derived and/or modified sequence opt2 from hemagglutinin__InfluenzaA__AEN68921

SEQ ID NO: 98636 - RNA, 1701 nt, Artificial Sequence; identical to SEQ ID NO: 95341
  derived and/or modified sequence opt2 from hemagglutinin__InfluenzaA__AEN68922

SEQ ID NO: 98637 - RNA, 1701 nt, Artificial Sequence; identical to SEQ ID NO: 95345
  derived and/or modified sequence opt2 from hemagglutinin__InfluenzaA__AEN68923

SEQ ID NO: 98638 - RNA, 1701 nt, Artificial Sequence; identical to SEQ ID NO: 95345
  derived and/or modified sequence opt2 from hemagglutinin__InfluenzaA__AEN68924

SEQ ID NO: 98639 - RNA, 1701 nt, Artificial Sequence
  derived and/or modified sequence opt2 from hemagglutinin__InfluenzaA__AEN68925
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucgagaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98640 - RNA, 1701 nt, Artificial Sequence
  derived and/or modified sequence opt2 from hemagglutinin__InfluenzaA__AEN68926
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucgccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98641 - RNA, 1701 nt, Artificial Sequence
  derived and/or modified sequence opt2 from hemagglutinin__InfluenzaA__AEN68927
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98642 - RNA, 1701 nt, Artificial Sequence; identical to SEQ ID NO: 97767
  derived and/or modified sequence opt2 from hemagglutinin__InfluenzaA__AEN68928

SEQ ID NO: 98643 - RNA, 1701 nt, Artificial Sequence
  derived and/or modified sequence opt2 from hemagglutinin__InfluenzaA__AEN68929
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98644 - RNA, 1701 nt, Artificial Sequence; identical to SEQ ID NO: 97096
  derived and/or modified sequence opt2 from hemagglutinin__InfluenzaA__AEN68930

SEQ ID NO: 98645 - RNA, 1701 nt, Artificial Sequence; identical to SEQ ID NO: 97096
  derived and/or modified sequence opt2 from hemagglutinin__InfluenzaA__AEN68931

SEQ ID NO: 98646 - RNA, 1701 nt, Artificial Sequence; identical to SEQ ID NO: 97096
  derived and/or modified sequence opt2 from hemagglutinin__InfluenzaA__AEN68932

SEQ ID NO: 98647 - RNA, 1701 nt, Artificial Sequence
  derived and/or modified sequence opt2 from hemagglutinin__InfluenzaA__AEN69426
augaaggccauccucgucguccuccucuacaccuucgccaccuccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98648 - RNA, 1701 nt, Artificial Sequence; identical to SEQ ID NO: 98432
  derived and/or modified sequence opt2 from hemagglutinin__InfluenzaA__AEN69475

SEQ ID NO: 98649 - RNA, 1701 nt, Artificial Sequence; identical to SEQ ID NO: 98432
  derived and/or modified sequence opt2 from hemagglutinin__InfluenzaA__AEN69481

SEQ ID NO: 98650 - RNA, 1701 nt, Artificial Sequence; identical to SEQ ID NO: 94434
  derived and/or modified sequence opt2 from hemagglutinin__InfluenzaA__AEO01032

SEQ ID NO: 98651 - RNA, 1701 nt, Artificial Sequence; identical to SEQ ID NO: 94534
  derived and/or modified sequence opt2 from hemagglutinin__InfluenzaA__AEO01033

SEQ ID NO: 98652 - RNA, 1701 nt, Artificial Sequence; identical to SEQ ID NO: 94534
  derived and/or modified sequence opt2 from hemagglutinin__InfluenzaA__AEO01034

SEQ ID NO: 98653 - RNA, 1701 nt, Artificial Sequence; identical to SEQ ID NO: 94168
  derived and/or modified sequence opt2 from hemagglutinin__InfluenzaA__AEO01035

SEQ ID NO: 98654 - RNA, 1701 nt, Artificial Sequence; identical to SEQ ID NO: 94534
  derived and/or modified sequence opt2 from hemagglutinin__InfluenzaA__AEO01036

SEQ ID NO: 98655 - RNA, 1701 nt, Artificial Sequence; identical to SEQ ID NO: 94423
  derived and/or modified sequence opt2 from hemagglutinin__InfluenzaA__AEO01037

SEQ ID NO: 98656 - RNA, 1701 nt, Artificial Sequence; identical to SEQ ID NO: 94534
  derived and/or modified sequence opt2 from hemagglutinin__InfluenzaA__AEO01038

SEQ ID NO: 98657 - RNA, 1701 nt, Artificial Sequence; identical to SEQ ID NO: 94361
  derived and/or modified sequence opt2 from hemagglutinin__InfluenzaA__AEO01039

SEQ ID NO: 98658 - RNA, 1701 nt, Artificial Sequence
  derived and/or modified sequence opt2 from hemagglutinin__InfluenzaA__AEO01040
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98659 - RNA, 1701 nt, Artificial Sequence; identical to SEQ ID NO: 94181
  derived and/or modified sequence opt2 from hemagglutinin__InfluenzaA__AEO01041

SEQ ID NO: 98660 - RNA, 1701 nt, Artificial Sequence; identical to SEQ ID NO: 94534
  derived and/or modified sequence opt2 from hemagglutinin__InfluenzaA__AEO01042

SEQ ID NO: 98661 - RNA, 1701 nt, Artificial Sequence
  derived and/or modified sequence opt2 from hemagglutinin__InfluenzaA__AEO01043
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccaacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98662 - RNA, 1701 nt, Artificial Sequence; identical to SEQ ID NO: 94181
  derived and/or modified sequence opt2 from hemagglutinin__InfluenzaA__AEO01044

SEQ ID NO: 98663 - RNA, 1701 nt, Artificial Sequence
  derived and/or modified sequence opt2 from hemagglutinin__InfluenzaA__AEO01045
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccucgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98664 - RNA, 1701 nt, Artificial Sequence; identical to SEQ ID NO: 94181
  derived and/or modified sequence opt2 from hemagglutinin__InfluenzaA__AEO01046

SEQ ID NO: 98665 - RNA, 1701 nt, Artificial Sequence; identical to SEQ ID NO: 94181
  derived and/or modified sequence opt2 from hemagglutinin__InfluenzaA__AEO01047

SEQ ID NO: 98666 - RNA, 1701 nt, Artificial Sequence
  derived and/or modified sequence opt2 from hemagglutinin__InfluenzaA__AEO01048
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugcaagaucugcaucuga

SEQ ID NO: 98667 - RNA, 1701 nt, Artificial Sequence; identical to SEQ ID NO: 95079
  derived and/or modified sequence opt2 from hemagglutinin__InfluenzaA__AEO01049

SEQ ID NO: 98668 - RNA, 1701 nt, Artificial Sequence; identical to SEQ ID NO: 94181
  derived and/or modified sequence opt2 from hemagglutinin__InfluenzaA__AEO01050

SEQ ID NO: 98669 - RNA, 1701 nt, Artificial Sequence; identical to SEQ ID NO: 94534
  derived and/or modified sequence opt2 from hemagglutinin__InfluenzaA__AEO01051

SEQ ID NO: 98670 - RNA, 1701 nt, Artificial Sequence
  derived and/or modified sequence opt2 from hemagglutinin__InfluenzaA__AEO01052
augaaggccaucaucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98671 - RNA, 1701 nt, Artificial Sequence; identical to SEQ ID NO: 94534
  derived and/or modified sequence opt2 from hemagglutinin__InfluenzaA__AEO01053

SEQ ID NO: 98672 - RNA, 1701 nt, Artificial Sequence; identical to SEQ ID NO: 94181
  derived and/or modified sequence opt2 from hemagglutinin__InfluenzaA__AEO01054

SEQ ID NO: 98673 - RNA, 1701 nt, Artificial Sequence; identical to SEQ ID NO: 94993
  derived and/or modified sequence opt2 from hemagglutinin__InfluenzaA__AEO01055

SEQ ID NO: 98674 - RNA, 1701 nt, Artificial Sequence; identical to SEQ ID NO: 94534
  derived and/or modified sequence opt2 from hemagglutinin__InfluenzaA__AEO01056

SEQ ID NO: 98675 - RNA, 1701 nt, Artificial Sequence; identical to SEQ ID NO: 94181
  derived and/or modified sequence opt2 from hemagglutinin__InfluenzaA__AEO01057

SEQ ID NO: 98676 - RNA, 1701 nt, Artificial Sequence; identical to SEQ ID NO: 94181
  derived and/or modified sequence opt2 from hemagglutinin__InfluenzaA__AEO01058

SEQ ID NO: 98677 - RNA, 1701 nt, Artificial Sequence; identical to SEQ ID NO: 94181
  derived and/or modified sequence opt2 from hemagglutinin__InfluenzaA__AEO01059

SEQ ID NO: 98678 - RNA, 1701 nt, Artificial Sequence; identical to SEQ ID NO: 94181
  derived and/or modified sequence opt2 from hemagglutinin__InfluenzaA__AEO01060

SEQ ID NO: 98679 - RNA, 1701 nt, Artificial Sequence; identical to SEQ ID NO: 94181
  derived and/or modified sequence opt2 from hemagglutinin__InfluenzaA__AEO01061

SEQ ID NO: 98680 - RNA, 1701 nt, Artificial Sequence; identical to SEQ ID NO: 94181
  derived and/or modified sequence opt2 from hemagglutinin__InfluenzaA__AEO01062

SEQ ID NO: 98681 - RNA, 1701 nt, Artificial Sequence; identical to SEQ ID NO: 94181
  derived and/or modified sequence opt2 from hemagglutinin__InfluenzaA__AEO01063

SEQ ID NO: 98682 - RNA, 1701 nt, Artificial Sequence; identical to SEQ ID NO: 94181
  derived and/or modified sequence opt2 from hemagglutinin__InfluenzaA__AEO01064

SEQ ID NO: 98683 - RNA, 1701 nt, Artificial Sequence; identical to SEQ ID NO: 94423
  derived and/or modified sequence opt2 from hemagglutinin__InfluenzaA__AEO01065

SEQ ID NO: 98684 - RNA, 1701 nt, Artificial Sequence; identical to SEQ ID NO: 94534
  derived and/or modified sequence opt2 from hemagglutinin__InfluenzaA__AEO01066

SEQ ID NO: 98685 - RNA, 1701 nt, Artificial Sequence
  derived and/or modified sequence opt2 from hemagglutinin__InfluenzaA__AEO01067
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagauggccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98686 - RNA, 1701 nt, Artificial Sequence; identical to SEQ ID NO: 94534
  derived and/or modified sequence opt2 from hemagglutinin__InfluenzaA__AEO01068

SEQ ID NO: 98687 - RNA, 1701 nt, Artificial Sequence; identical to SEQ ID NO: 94181
  derived and/or modified sequence opt2 from hemagglutinin__InfluenzaA__AEO01069

SEQ ID NO: 98688 - RNA, 1701 nt, Artificial Sequence; identical to SEQ ID NO: 94534
  derived and/or modified sequence opt2 from hemagglutinin__InfluenzaA__AEO01070

SEQ ID NO: 98689 - RNA, 1701 nt, Artificial Sequence; identical to SEQ ID NO: 94181
  derived and/or modified sequence opt2 from hemagglutinin__InfluenzaA__AEO01071

SEQ ID NO: 98690 - RNA, 1701 nt, Artificial Sequence
  derived and/or modified sequence opt2 from hemagglutinin__InfluenzaA__AEO01073
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98691 - RNA, 1701 nt, Artificial Sequence; identical to SEQ ID NO: 94423
  derived and/or modified sequence opt2 from hemagglutinin__InfluenzaA__AEO01074

SEQ ID NO: 98692 - RNA, 1701 nt, Artificial Sequence; identical to SEQ ID NO: 94534
  derived and/or modified sequence opt2 from hemagglutinin__InfluenzaA__AEO01075

SEQ ID NO: 98693 - RNA, 1701 nt, Artificial Sequence; identical to SEQ ID NO: 94534
  derived and/or modified sequence opt2 from hemagglutinin__InfluenzaA__AEO01076

SEQ ID NO: 98694 - RNA, 1701 nt, Artificial Sequence
  derived and/or modified sequence opt2 from hemagglutinin__InfluenzaA__AEO01077
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggagaacgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98695 - RNA, 1701 nt, Artificial Sequence; identical to SEQ ID NO: 94181
  derived and/or modified sequence opt2 from hemagglutinin__InfluenzaA__AEO01078

SEQ ID NO: 98696 - RNA, 1701 nt, Artificial Sequence; identical to SEQ ID NO: 94181
  derived and/or modified sequence opt2 from hemagglutinin__InfluenzaA__AEO01079

SEQ ID NO: 98697 - RNA, 1701 nt, Artificial Sequence; identical to SEQ ID NO: 94181
  derived and/or modified sequence opt2 from hemagglutinin__InfluenzaA__AEO01080

SEQ ID NO: 98698 - RNA, 1701 nt, Artificial Sequence; identical to SEQ ID NO: 94534
  derived and/or modified sequence opt2 from hemagglutinin__InfluenzaA__AEO01081

SEQ ID NO: 98699 - RNA, 1701 nt, Artificial Sequence; identical to SEQ ID NO: 94181
  derived and/or modified sequence opt2 from hemagglutinin__InfluenzaA__AEO01082

SEQ ID NO: 98700 - RNA, 1701 nt, Artificial Sequence; identical to SEQ ID NO: 94181
  derived and/or modified sequence opt2 from hemagglutinin__InfluenzaA__AEO01083

SEQ ID NO: 98701 - RNA, 1701 nt, Artificial Sequence; identical to SEQ ID NO: 94181
  derived and/or modified sequence opt2 from hemagglutinin__InfluenzaA__AEO01084

SEQ ID NO: 98702 - RNA, 1701 nt, Artificial Sequence; identical to SEQ ID NO: 94534
  derived and/or modified sequence opt2 from hemagglutinin__InfluenzaA__AEO01085

SEQ ID NO: 98703 - RNA, 1701 nt, Artificial Sequence; identical to SEQ ID NO: 94181
  derived and/or modified sequence opt2 from hemagglutinin__InfluenzaA__AEO01086

SEQ ID NO: 98704 - RNA, 1701 nt, Artificial Sequence; identical to SEQ ID NO: 94534
  derived and/or modified sequence opt2 from hemagglutinin__InfluenzaA__AEO01087

SEQ ID NO: 98705 - RNA, 1701 nt, Artificial Sequence; identical to SEQ ID NO: 94361
  derived and/or modified sequence opt2 from hemagglutinin__InfluenzaA__AEO01088

SEQ ID NO: 98706 - RNA, 1701 nt, Artificial Sequence; identical to SEQ ID NO: 94534
  derived and/or modified sequence opt2 from hemagglutinin__InfluenzaA__AEO01089

SEQ ID NO: 98707 - RNA, 1701 nt, Artificial Sequence; identical to SEQ ID NO: 94534
  derived and/or modified sequence opt2 from hemagglutinin__InfluenzaA__AEO01090

SEQ ID NO: 98708 - RNA, 1701 nt, Artificial Sequence; identical to SEQ ID NO: 94534
  derived and/or modified sequence opt2 from hemagglutinin__InfluenzaA__AEO01091

SEQ ID NO: 98709 - RNA, 1701 nt, Artificial Sequence
  derived and/or modified sequence opt2 from hemagglutinin__InfluenzaA__AEO01092
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagcgcguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98710 - RNA, 1701 nt, Artificial Sequence; identical to SEQ ID NO: 94181
  derived and/or modified sequence opt2 from hemagglutinin__InfluenzaA__AEO01093

SEQ ID NO: 98711 - RNA, 1701 nt, Artificial Sequence; identical to SEQ ID NO: 94181
  derived and/or modified sequence opt2 from hemagglutinin__InfluenzaA__AEO01094

SEQ ID NO: 98712 - RNA, 1701 nt, Artificial Sequence; identical to SEQ ID NO: 97388
  derived and/or modified sequence opt2 from hemagglutinin__InfluenzaA__AEO01095

SEQ ID NO: 98713 - RNA, 1701 nt, Artificial Sequence; identical to SEQ ID NO: 94534
  derived and/or modified sequence opt2 from hemagglutinin__InfluenzaA__AEO01096

SEQ ID NO: 98714 - RNA, 1701 nt, Artificial Sequence; identical to SEQ ID NO: 94534
  derived and/or modified sequence opt2 from hemagglutinin__InfluenzaA__AEO01097

SEQ ID NO: 98715 - RNA, 1701 nt, Artificial Sequence; identical to SEQ ID NO: 94534
  derived and/or modified sequence opt2 from hemagglutinin__InfluenzaA__AEO01098

SEQ ID NO: 98716 - RNA, 1701 nt, Artificial Sequence; identical to SEQ ID NO: 94181
  derived and/or modified sequence opt2 from hemagglutinin__InfluenzaA__AEO01099

SEQ ID NO: 98717 - RNA, 1701 nt, Artificial Sequence; identical to SEQ ID NO: 94423
  derived and/or modified sequence opt2 from hemagglutinin__InfluenzaA__AEO01100

SEQ ID NO: 98718 - RNA, 1701 nt, Artificial Sequence; identical to SEQ ID NO: 94181
  derived and/or modified sequence opt2 from hemagglutinin__InfluenzaA__AEO01101

SEQ ID NO: 98719 - RNA, 1701 nt, Artificial Sequence; identical to SEQ ID NO: 94181
  derived and/or modified sequence opt2 from hemagglutinin__InfluenzaA__AEO01102

SEQ ID NO: 98720 - RNA, 1701 nt, Artificial Sequence; identical to SEQ ID NO: 94534
  derived and/or modified sequence opt2 from hemagglutinin__InfluenzaA__AEO01103

SEQ ID NO: 98721 - RNA, 1701 nt, Artificial Sequence; identical to SEQ ID NO: 94534
  derived and/or modified sequence opt2 from hemagglutinin__InfluenzaA__AEO01104

SEQ ID NO: 98722 - RNA, 1701 nt, Artificial Sequence
  derived and/or modified sequence opt2 from hemagglutinin__InfluenzaA__AEO01105
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccuccaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98723 - RNA, 1701 nt, Artificial Sequence; identical to SEQ ID NO: 94534
  derived and/or modified sequence opt2 from hemagglutinin__InfluenzaA__AEO01106

SEQ ID NO: 98724 - RNA, 1701 nt, Artificial Sequence; identical to SEQ ID NO: 94181
  derived and/or modified sequence opt2 from hemagglutinin__InfluenzaA__AEO01107

SEQ ID NO: 98725 - RNA, 1701 nt, Artificial Sequence; identical to SEQ ID NO: 94181
  derived and/or modified sequence opt2 from hemagglutinin__InfluenzaA__AEO01108

SEQ ID NO: 98726 - RNA, 1701 nt, Artificial Sequence; identical to SEQ ID NO: 94181
  derived and/or modified sequence opt2 from hemagglutinin__InfluenzaA__AEO01109

SEQ ID NO: 98727 - RNA, 1701 nt, Artificial Sequence; identical to SEQ ID NO: 94181
  derived and/or modified sequence opt2 from hemagglutinin__InfluenzaA__AEO01110

SEQ ID NO: 98728 - RNA, 1701 nt, Artificial Sequence; identical to SEQ ID NO: 94181
  derived and/or modified sequence opt2 from hemagglutinin__InfluenzaA__AEO01111

SEQ ID NO: 98729 - RNA, 1701 nt, Artificial Sequence; identical to SEQ ID NO: 94181
  derived and/or modified sequence opt2 from hemagglutinin__InfluenzaA__AEO01112

SEQ ID NO: 98730 - RNA, 1701 nt, Artificial Sequence
  derived and/or modified sequence opt2 from hemagglutinin__InfluenzaA__AEO01113
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98731 - RNA, 1701 nt, Artificial Sequence; identical to SEQ ID NO: 94423
  derived and/or modified sequence opt2 from hemagglutinin__InfluenzaA__AEO01114

SEQ ID NO: 98732 - RNA, 1701 nt, Artificial Sequence
  derived and/or modified sequence opt2 from hemagglutinin__InfluenzaA__AEO01115
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98733 - RNA, 1701 nt, Artificial Sequence; identical to SEQ ID NO: 94181
  derived and/or modified sequence opt2 from hemagglutinin__InfluenzaA__AEO01116

SEQ ID NO: 98734 - RNA, 1701 nt, Artificial Sequence; identical to SEQ ID NO: 94181
  derived and/or modified sequence opt2 from hemagglutinin__InfluenzaA__AEO01117

SEQ ID NO: 98735 - RNA, 1701 nt, Artificial Sequence; identical to SEQ ID NO: 95047
  derived and/or modified sequence opt2 from hemagglutinin__InfluenzaA__AEO01118

SEQ ID NO: 98736 - RNA, 1701 nt, Artificial Sequence; identical to SEQ ID NO: 94181
  derived and/or modified sequence opt2 from hemagglutinin__InfluenzaA__AEO01119

SEQ ID NO: 98737 - RNA, 1701 nt, Artificial Sequence
  derived and/or modified sequence opt2 from hemagglutinin__InfluenzaA__AEO01120
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98738 - RNA, 1701 nt, Artificial Sequence; identical to SEQ ID NO: 94181
  derived and/or modified sequence opt2 from hemagglutinin__InfluenzaA__AEO01121

SEQ ID NO: 98739 - RNA, 1701 nt, Artificial Sequence; identical to SEQ ID NO: 94534
  derived and/or modified sequence opt2 from hemagglutinin__InfluenzaA__AEO01122

SEQ ID NO: 98740 - RNA, 1701 nt, Artificial Sequence; identical to SEQ ID NO: 94181
  derived and/or modified sequence opt2 from hemagglutinin__InfluenzaA__AEO01123

SEQ ID NO: 98741 - RNA, 1701 nt, Artificial Sequence; identical to SEQ ID NO: 94181
  derived and/or modified sequence opt2 from hemagglutinin__InfluenzaA__AEO01124

SEQ ID NO: 98742 - RNA, 1701 nt, Artificial Sequence; identical to SEQ ID NO: 94534
  derived and/or modified sequence opt2 from hemagglutinin__InfluenzaA__AEO01125

SEQ ID NO: 98743 - RNA, 1701 nt, Artificial Sequence
  derived and/or modified sequence opt2 from hemagglutinin__InfluenzaA__AEO01126
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98744 - RNA, 1701 nt, Artificial Sequence; identical to SEQ ID NO: 94181
  derived and/or modified sequence opt2 from hemagglutinin__InfluenzaA__AEO01127

SEQ ID NO: 98745 - RNA, 1701 nt, Artificial Sequence; identical to SEQ ID NO: 94181
  derived and/or modified sequence opt2 from hemagglutinin__InfluenzaA__AEO01128

SEQ ID NO: 98746 - RNA, 1701 nt, Artificial Sequence; identical to SEQ ID NO: 94534
  derived and/or modified sequence opt2 from hemagglutinin__InfluenzaA__AEO01129

SEQ ID NO: 98747 - RNA, 1701 nt, Artificial Sequence; identical to SEQ ID NO: 94181
  derived and/or modified sequence opt2 from hemagglutinin__InfluenzaA__AEO01130

SEQ ID NO: 98748 - RNA, 1701 nt, Artificial Sequence; identical to SEQ ID NO: 94534
  derived and/or modified sequence opt2 from hemagglutinin__InfluenzaA__AEO01131

SEQ ID NO: 98749 - RNA, 1701 nt, Artificial Sequence; identical to SEQ ID NO: 94181
  derived and/or modified sequence opt2 from hemagglutinin__InfluenzaA__AEO01132

SEQ ID NO: 98750 - RNA, 1701 nt, Artificial Sequence
  derived and/or modified sequence opt2 from hemagglutinin__InfluenzaA__AEO01133
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucgucgucucccucggcgccaucuccuucuggaugugcuccaacggcucccuccagugccgcaucugcaucuga

SEQ ID NO: 98751 - RNA, 1701 nt, Artificial Sequence; identical to SEQ ID NO: 94534
  derived and/or modified sequence opt2 from hemagglutinin__InfluenzaA__AEO01134

SEQ ID NO: 98752 - RNA, 1701 nt, Artificial Sequence; identical to SEQ ID NO: 94534
  derived and/or modified sequence opt2 from hemagglutinin__InfluenzaA__AEO01135

SEQ ID NO: 98753 - RNA, 1701 nt, Artificial Sequence; identical to SEQ ID NO: 94181
  derived and/or modified sequence opt2 from hemagglutinin__InfluenzaA__AEO01136

SEQ ID NO: 98754 - RNA, 1701 nt, Artificial Sequence; identical to SEQ ID NO: 94628
  derived and/or modified sequence opt2 from hemagglutinin__InfluenzaA__AEO01137

SEQ ID NO: 98755 - RNA, 1701 nt, Artificial Sequence; identical to SEQ ID NO: 94628
  derived and/or modified sequence opt2 from hemagglutinin__InfluenzaA__AEO01138

SEQ ID NO: 98756 - RNA, 1701 nt, Artificial Sequence; identical to SEQ ID NO: 94181
  derived and/or modified sequence opt2 from hemagglutinin__InfluenzaA__AEO01139

SEQ ID NO: 98757 - RNA, 1701 nt, Artificial Sequence; identical to SEQ ID NO: 94181
  derived and/or modified sequence opt2 from hemagglutinin__InfluenzaA__AEO01140

SEQ ID NO: 98758 - RNA, 1701 nt, Artificial Sequence; identical to SEQ ID NO: 94181
  derived and/or modified sequence opt2 from hemagglutinin__InfluenzaA__AEO01141

SEQ ID NO: 98759 - RNA, 1701 nt, Artificial Sequence; identical to SEQ ID NO: 94181
  derived and/or modified sequence opt2 from hemagglutinin__InfluenzaA__AEO01142

SEQ ID NO: 98760 - RNA, 1701 nt, Artificial Sequence
  derived and/or modified sequence opt2 from hemagglutinin__InfluenzaA__AEO01144
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98761 - RNA, 1701 nt, Artificial Sequence; identical to SEQ ID NO: 94361
  derived and/or modified sequence opt2 from hemagglutinin__InfluenzaA__AEO01145

SEQ ID NO: 98762 - RNA, 1701 nt, Artificial Sequence
  derived and/or modified sequence opt2 from hemagglutinin__InfluenzaA__AEO01146
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaaccccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98763 - RNA, 1701 nt, Artificial Sequence; identical to SEQ ID NO: 94181
  derived and/or modified sequence opt2 from hemagglutinin__InfluenzaA__AEO01147

SEQ ID NO: 98764 - RNA, 1701 nt, Artificial Sequence; identical to SEQ ID NO: 94534
  derived and/or modified sequence opt2 from hemagglutinin__InfluenzaA__AEO01148

SEQ ID NO: 98765 - RNA, 1701 nt, Artificial Sequence; identical to SEQ ID NO: 94534
  derived and/or modified sequence opt2 from hemagglutinin__InfluenzaA__AEO01149

SEQ ID NO: 98766 - RNA, 1701 nt, Artificial Sequence; identical to SEQ ID NO: 97388
  derived and/or modified sequence opt2 from hemagglutinin__InfluenzaA__AEO01150

SEQ ID NO: 98767 - RNA, 1701 nt, Artificial Sequence; identical to SEQ ID NO: 94181
  derived and/or modified sequence opt2 from hemagglutinin__InfluenzaA__AEO01151

SEQ ID NO: 98768 - RNA, 1701 nt, Artificial Sequence
  derived and/or modified sequence opt2 from hemagglutinin__InfluenzaA__AEO01152
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98769 - RNA, 1701 nt, Artificial Sequence
  derived and/or modified sequence opt2 from hemagglutinin__InfluenzaA__AEO01153
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacaacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccaacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98770 - RNA, 1701 nt, Artificial Sequence; identical to SEQ ID NO: 94181
  derived and/or modified sequence opt2 from hemagglutinin__InfluenzaA__AEO01154

SEQ ID NO: 98771 - RNA, 1701 nt, Artificial Sequence; identical to SEQ ID NO: 94534
  derived and/or modified sequence opt2 from hemagglutinin__InfluenzaA__AEO01155

SEQ ID NO: 98772 - RNA, 1701 nt, Artificial Sequence; identical to SEQ ID NO: 94534
  derived and/or modified sequence opt2 from hemagglutinin__InfluenzaA__AEO01156

SEQ ID NO: 98773 - RNA, 1701 nt, Artificial Sequence; identical to SEQ ID NO: 94181
  derived and/or modified sequence opt2 from hemagglutinin__InfluenzaA__AEO01157

SEQ ID NO: 98774 - RNA, 1701 nt, Artificial Sequence; identical to SEQ ID NO: 94181
  derived and/or modified sequence opt2 from hemagglutinin__InfluenzaA__AEO01158

SEQ ID NO: 98775 - RNA, 1701 nt, Artificial Sequence; identical to SEQ ID NO: 94181
  derived and/or modified sequence opt2 from hemagglutinin__InfluenzaA__AEO01159

SEQ ID NO: 98776 - RNA, 1701 nt, Artificial Sequence
  derived and/or modified sequence opt2 from hemagglutinin__InfluenzaA__AEO01160
augaaggccauccucgucgcccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98777 - RNA, 1701 nt, Artificial Sequence; identical to SEQ ID NO: 94181
  derived and/or modified sequence opt2 from hemagglutinin__InfluenzaA__AEO01161

SEQ ID NO: 98778 - RNA, 1701 nt, Artificial Sequence; identical to SEQ ID NO: 94534
  derived and/or modified sequence opt2 from hemagglutinin__InfluenzaA__AEO01162

SEQ ID NO: 98779 - RNA, 1701 nt, Artificial Sequence; identical to SEQ ID NO: 94534
  derived and/or modified sequence opt2 from hemagglutinin__InfluenzaA__AEO01163

SEQ ID NO: 98780 - RNA, 1701 nt, Artificial Sequence; identical to SEQ ID NO: 94534
  derived and/or modified sequence opt2 from hemagglutinin__InfluenzaA__AEO01164

SEQ ID NO: 98781 - RNA, 1701 nt, Artificial Sequence
  derived and/or modified sequence opt2 from hemagglutinin__InfluenzaA__AEO01165
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaaguucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98782 - RNA, 1701 nt, Artificial Sequence; identical to SEQ ID NO: 94534
  derived and/or modified sequence opt2 from hemagglutinin__InfluenzaA__AEO01166

SEQ ID NO: 98783 - RNA, 1701 nt, Artificial Sequence
  derived and/or modified sequence opt2 from hemagglutinin__InfluenzaA__AEO01167
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98784 - RNA, 1701 nt, Artificial Sequence; identical to SEQ ID NO: 94181
  derived and/or modified sequence opt2 from hemagglutinin__InfluenzaA__AEO01168

SEQ ID NO: 98785 - RNA, 1701 nt, Artificial Sequence; identical to SEQ ID NO: 94534
  derived and/or modified sequence opt2 from hemagglutinin__InfluenzaA__AEO01169

SEQ ID NO: 98786 - RNA, 1701 nt, Artificial Sequence; identical to SEQ ID NO: 94534
  derived and/or modified sequence opt2 from hemagglutinin__InfluenzaA__AEO01170

SEQ ID NO: 98787 - RNA, 1701 nt, Artificial Sequence; identical to SEQ ID NO: 94534
  derived and/or modified sequence opt2 from hemagglutinin__InfluenzaA__AEO01171

SEQ ID NO: 98788 - RNA, 1701 nt, Artificial Sequence; identical to SEQ ID NO: 94181
  derived and/or modified sequence opt2 from hemagglutinin__InfluenzaA__AEO01172

SEQ ID NO: 98789 - RNA, 1701 nt, Artificial Sequence
  derived and/or modified sequence opt2 from hemagglutinin__InfluenzaA__AEO01173
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcggcaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98790 - RNA, 1701 nt, Artificial Sequence
  derived and/or modified sequence opt2 from hemagglutinin__InfluenzaA__AEO01174
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98791 - RNA, 1701 nt, Artificial Sequence; identical to SEQ ID NO: 94181
  derived and/or modified sequence opt2 from hemagglutinin__InfluenzaA__AEO01176

SEQ ID NO: 98792 - RNA, 1701 nt, Artificial Sequence; identical to SEQ ID NO: 94181
  derived and/or modified sequence opt2 from hemagglutinin__InfluenzaA__AEO01177

SEQ ID NO: 98793 - RNA, 1701 nt, Artificial Sequence; identical to SEQ ID NO: 94534
  derived and/or modified sequence opt2 from hemagglutinin__InfluenzaA__AEO01179

SEQ ID NO: 98794 - RNA, 1701 nt, Artificial Sequence; identical to SEQ ID NO: 94534
  derived and/or modified sequence opt2 from hemagglutinin__InfluenzaA__AEO01180

SEQ ID NO: 98795 - RNA, 1701 nt, Artificial Sequence; identical to SEQ ID NO: 94534
  derived and/or modified sequence opt2 from hemagglutinin__InfluenzaA__AEO01181

SEQ ID NO: 98796 - RNA, 1701 nt, Artificial Sequence; identical to SEQ ID NO: 94534
  derived and/or modified sequence opt2 from hemagglutinin__InfluenzaA__AEO01182

SEQ ID NO: 98797 - RNA, 1701 nt, Artificial Sequence; identical to SEQ ID NO: 94181
  derived and/or modified sequence opt2 from hemagglutinin__InfluenzaA__AEO01183

SEQ ID NO: 98798 - RNA, 1701 nt, Artificial Sequence; identical to SEQ ID NO: 94534
  derived and/or modified sequence opt2 from hemagglutinin__InfluenzaA__AEO01184

SEQ ID NO: 98799 - RNA, 1701 nt, Artificial Sequence; identical to SEQ ID NO: 94181
  derived and/or modified sequence opt2 from hemagglutinin__InfluenzaA__AEO01185

SEQ ID NO: 98800 - RNA, 1701 nt, Artificial Sequence; identical to SEQ ID NO: 94181
  derived and/or modified sequence opt2 from hemagglutinin__InfluenzaA__AEO01186

SEQ ID NO: 98801 - RNA, 1701 nt, Artificial Sequence; identical to SEQ ID NO: 94181
  derived and/or modified sequence opt2 from hemagglutinin__InfluenzaA__AEO01187

SEQ ID NO: 98802 - RNA, 1701 nt, Artificial Sequence; identical to SEQ ID NO: 94181
  derived and/or modified sequence opt2 from hemagglutinin__InfluenzaA__AEO01188

SEQ ID NO: 98803 - RNA, 1701 nt, Artificial Sequence; identical to SEQ ID NO: 94181
  derived and/or modified sequence opt2 from hemagglutinin__InfluenzaA__AEO01189

SEQ ID NO: 98804 - RNA, 1701 nt, Artificial Sequence; identical to SEQ ID NO: 94181
  derived and/or modified sequence opt2 from hemagglutinin__InfluenzaA__AEO01191

SEQ ID NO: 98805 - RNA, 1701 nt, Artificial Sequence; identical to SEQ ID NO: 94181
  derived and/or modified sequence opt2 from hemagglutinin__InfluenzaA__AEO01192

SEQ ID NO: 98806 - RNA, 1701 nt, Artificial Sequence; identical to SEQ ID NO: 95495
  derived and/or modified sequence opt2 from hemagglutinin__InfluenzaA__AEO01193

SEQ ID NO: 98807 - RNA, 1701 nt, Artificial Sequence; identical to SEQ ID NO: 94534
  derived and/or modified sequence opt2 from hemagglutinin__InfluenzaA__AEO01194

SEQ ID NO: 98808 - RNA, 1701 nt, Artificial Sequence; identical to SEQ ID NO: 94534
  derived and/or modified sequence opt2 from hemagglutinin__InfluenzaA__AEO01195

SEQ ID NO: 98809 - RNA, 1701 nt, Artificial Sequence; identical to SEQ ID NO: 94181
  derived and/or modified sequence opt2 from hemagglutinin__InfluenzaA__AEO01196

SEQ ID NO: 98810 - RNA, 1701 nt, Artificial Sequence; identical to SEQ ID NO: 94181
  derived and/or modified sequence opt2 from hemagglutinin__InfluenzaA__AEO01197

SEQ ID NO: 98811 - RNA, 1701 nt, Artificial Sequence; identical to SEQ ID NO: 94534
  derived and/or modified sequence opt2 from hemagglutinin__InfluenzaA__AEO01198

SEQ ID NO: 98812 - RNA, 1701 nt, Artificial Sequence; identical to SEQ ID NO: 95047
  derived and/or modified sequence opt2 from hemagglutinin__InfluenzaA__AEO01200

SEQ ID NO: 98813 - RNA, 1701 nt, Artificial Sequence
  derived and/or modified sequence opt2 from hemagglutinin__InfluenzaA__AEO01201
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggagaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98814 - RNA, 1701 nt, Artificial Sequence; identical to SEQ ID NO: 94181
  derived and/or modified sequence opt2 from hemagglutinin__InfluenzaA__AEO01202

SEQ ID NO: 98815 - RNA, 1701 nt, Artificial Sequence; identical to SEQ ID NO: 95817
  derived and/or modified sequence opt2 from hemagglutinin__InfluenzaA__AEO01203

SEQ ID NO: 98816 - RNA, 1701 nt, Artificial Sequence; identical to SEQ ID NO: 94181
  derived and/or modified sequence opt2 from hemagglutinin__InfluenzaA__AEO01204

SEQ ID NO: 98817 - RNA, 1701 nt, Artificial Sequence; identical to SEQ ID NO: 94181
  derived and/or modified sequence opt2 from hemagglutinin__InfluenzaA__AEO01205

SEQ ID NO: 98818 - RNA, 1701 nt, Artificial Sequence; identical to SEQ ID NO: 94181
  derived and/or modified sequence opt2 from hemagglutinin__InfluenzaA__AEO01206

SEQ ID NO: 98819 - RNA, 1701 nt, Artificial Sequence; identical to SEQ ID NO: 94181
  derived and/or modified sequence opt2 from hemagglutinin__InfluenzaA__AEO01207

SEQ ID NO: 98820 - RNA, 1701 nt, Artificial Sequence; identical to SEQ ID NO: 94181
  derived and/or modified sequence opt2 from hemagglutinin__InfluenzaA__AEO01208

SEQ ID NO: 98821 - RNA, 1701 nt, Artificial Sequence; identical to SEQ ID NO: 94534
  derived and/or modified sequence opt2 from hemagglutinin__InfluenzaA__AEO01209

SEQ ID NO: 98822 - RNA, 1701 nt, Artificial Sequence; identical to SEQ ID NO: 94181
  derived and/or modified sequence opt2 from hemagglutinin__InfluenzaA__AEO01210

SEQ ID NO: 98823 - RNA, 1701 nt, Artificial Sequence; identical to SEQ ID NO: 94534
  derived and/or modified sequence opt2 from hemagglutinin__InfluenzaA__AEO01211

SEQ ID NO: 98824 - RNA, 1701 nt, Artificial Sequence; identical to SEQ ID NO: 94181
  derived and/or modified sequence opt2 from hemagglutinin__InfluenzaA__AEO01212

SEQ ID NO: 98825 - RNA, 1701 nt, Artificial Sequence; identical to SEQ ID NO: 94181
  derived and/or modified sequence opt2 from hemagglutinin__InfluenzaA__AEO01213

SEQ ID NO: 98826 - RNA, 1701 nt, Artificial Sequence
  derived and/or modified sequence opt2 from hemagglutinin__InfluenzaA__AEO01214
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98827 - RNA, 1701 nt, Artificial Sequence; identical to SEQ ID NO: 94534
  derived and/or modified sequence opt2 from hemagglutinin__InfluenzaA__AEO01215

SEQ ID NO: 98828 - RNA, 1701 nt, Artificial Sequence
  derived and/or modified sequence opt2 from hemagglutinin__InfluenzaA__AEO01216
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcgucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98829 - RNA, 1701 nt, Artificial Sequence; identical to SEQ ID NO: 94534
  derived and/or modified sequence opt2 from hemagglutinin__InfluenzaA__AEO01217

SEQ ID NO: 98830 - RNA, 1701 nt, Artificial Sequence; identical to SEQ ID NO: 94534
  derived and/or modified sequence opt2 from hemagglutinin__InfluenzaA__AEO01218

SEQ ID NO: 98831 - RNA, 1701 nt, Artificial Sequence; identical to SEQ ID NO: 94534
  derived and/or modified sequence opt2 from hemagglutinin__InfluenzaA__AEO01219

SEQ ID NO: 98832 - RNA, 1701 nt, Artificial Sequence; identical to SEQ ID NO: 94272
  derived and/or modified sequence opt2 from hemagglutinin__InfluenzaA__AEO01220

SEQ ID NO: 98833 - RNA, 1701 nt, Artificial Sequence; identical to SEQ ID NO: 94181
  derived and/or modified sequence opt2 from hemagglutinin__InfluenzaA__AEO01221

SEQ ID NO: 98834 - RNA, 1701 nt, Artificial Sequence; identical to SEQ ID NO: 94181
  derived and/or modified sequence opt2 from hemagglutinin__InfluenzaA__AEO01222

SEQ ID NO: 98835 - RNA, 1701 nt, Artificial Sequence; identical to SEQ ID NO: 94534
  derived and/or modified sequence opt2 from hemagglutinin__InfluenzaA__AEO01223

SEQ ID NO: 98836 - RNA, 1701 nt, Artificial Sequence
  derived and/or modified sequence opt2 from hemagglutinin__InfluenzaA__AEO01224
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaccgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98837 - RNA, 1701 nt, Artificial Sequence
  derived and/or modified sequence opt2 from hemagglutinin__InfluenzaA__AEO01225
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggaccgucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98838 - RNA, 1701 nt, Artificial Sequence
  derived and/or modified sequence opt2 from hemagglutinin__InfluenzaA__AEO01226
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgacggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98839 - RNA, 1701 nt, Artificial Sequence; identical to SEQ ID NO: 96348
  derived and/or modified sequence opt2 from hemagglutinin__InfluenzaA__AEO01227

SEQ ID NO: 98840 - RNA, 1701 nt, Artificial Sequence; identical to SEQ ID NO: 94181
  derived and/or modified sequence opt2 from hemagglutinin__InfluenzaA__AEO01228

SEQ ID NO: 98841 - RNA, 1701 nt, Artificial Sequence; identical to SEQ ID NO: 94181
  derived and/or modified sequence opt2 from hemagglutinin__InfluenzaA__AEO01229

SEQ ID NO: 98842 - RNA, 1701 nt, Artificial Sequence
  derived and/or modified sequence opt2 from hemagglutinin__InfluenzaA__AEO01230
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98843 - RNA, 1701 nt, Artificial Sequence; identical to SEQ ID NO: 94181
  derived and/or modified sequence opt2 from hemagglutinin__InfluenzaA__AEO01231

SEQ ID NO: 98844 - RNA, 1701 nt, Artificial Sequence; identical to SEQ ID NO: 94534
  derived and/or modified sequence opt2 from hemagglutinin__InfluenzaA__AEO01232

SEQ ID NO: 98845 - RNA, 1701 nt, Artificial Sequence; identical to SEQ ID NO: 94181
  derived and/or modified sequence opt2 from hemagglutinin__InfluenzaA__AEO01233

SEQ ID NO: 98846 - RNA, 1701 nt, Artificial Sequence; identical to SEQ ID NO: 94181
  derived and/or modified sequence opt2 from hemagglutinin__InfluenzaA__AEO01234

SEQ ID NO: 98847 - RNA, 1701 nt, Artificial Sequence; identical to SEQ ID NO: 94181
  derived and/or modified sequence opt2 from hemagglutinin__InfluenzaA__AEO01235

SEQ ID NO: 98848 - RNA, 1701 nt, Artificial Sequence; identical to SEQ ID NO: 98053
  derived and/or modified sequence opt2 from hemagglutinin__InfluenzaA__AEO01236

SEQ ID NO: 98849 - RNA, 1701 nt, Artificial Sequence; identical to SEQ ID NO: 94181
  derived and/or modified sequence opt2 from hemagglutinin__InfluenzaA__AEO01237

SEQ ID NO: 98850 - RNA, 1701 nt, Artificial Sequence; identical to SEQ ID NO: 94181
  derived and/or modified sequence opt2 from hemagglutinin__InfluenzaA__AEO01238

SEQ ID NO: 98851 - RNA, 1701 nt, Artificial Sequence; identical to SEQ ID NO: 94181
  derived and/or modified sequence opt2 from hemagglutinin__InfluenzaA__AEO01240

SEQ ID NO: 98852 - RNA, 1701 nt, Artificial Sequence; identical to SEQ ID NO: 94534
  derived and/or modified sequence opt2 from hemagglutinin__InfluenzaA__AEO01241

SEQ ID NO: 98853 - RNA, 1701 nt, Artificial Sequence; identical to SEQ ID NO: 94181
  derived and/or modified sequence opt2 from hemagglutinin__InfluenzaA__AEO01242

SEQ ID NO: 98854 - RNA, 1701 nt, Artificial Sequence
  derived and/or modified sequence opt2 from hemagglutinin__InfluenzaA__AEO01244
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98855 - RNA, 1701 nt, Artificial Sequence; identical to SEQ ID NO: 94181
  derived and/or modified sequence opt2 from hemagglutinin__InfluenzaA__AEO01245

SEQ ID NO: 98856 - RNA, 1701 nt, Artificial Sequence
  derived and/or modified sequence opt2 from hemagglutinin__InfluenzaA__AEO01247
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcauccucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98857 - RNA, 1701 nt, Artificial Sequence; identical to SEQ ID NO: 94181
  derived and/or modified sequence opt2 from hemagglutinin__InfluenzaA__AEO01248

SEQ ID NO: 98858 - RNA, 1701 nt, Artificial Sequence; identical to SEQ ID NO: 94181
  derived and/or modified sequence opt2 from hemagglutinin__InfluenzaA__AEO01249

SEQ ID NO: 98859 - RNA, 1701 nt, Artificial Sequence
  derived and/or modified sequence opt2 from hemagglutinin__InfluenzaA__AEO01250
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgaggacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98860 - RNA, 1701 nt, Artificial Sequence; identical to SEQ ID NO: 95778
  derived and/or modified sequence opt2 from hemagglutinin__InfluenzaA__AEO01251

SEQ ID NO: 98861 - RNA, 1701 nt, Artificial Sequence; identical to SEQ ID NO: 94181
  derived and/or modified sequence opt2 from hemagglutinin__InfluenzaA__AEO01252

SEQ ID NO: 98862 - RNA, 1701 nt, Artificial Sequence; identical to SEQ ID NO: 94181
  derived and/or modified sequence opt2 from hemagglutinin__InfluenzaA__AEO01253

SEQ ID NO: 98863 - RNA, 1701 nt, Artificial Sequence
  derived and/or modified sequence opt2 from hemagglutinin__InfluenzaA__AEO01254
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacaacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98864 - RNA, 1701 nt, Artificial Sequence; identical to SEQ ID NO: 94628
  derived and/or modified sequence opt2 from hemagglutinin__InfluenzaA__AEO01256

SEQ ID NO: 98865 - RNA, 1701 nt, Artificial Sequence; identical to SEQ ID NO: 97600
  derived and/or modified sequence opt2 from hemagglutinin__InfluenzaA__AEO01257

SEQ ID NO: 98866 - RNA, 1701 nt, Artificial Sequence; identical to SEQ ID NO: 94181
  derived and/or modified sequence opt2 from hemagglutinin__InfluenzaA__AEO01258

SEQ ID NO: 98867 - RNA, 1701 nt, Artificial Sequence; identical to SEQ ID NO: 98863
  derived and/or modified sequence opt2 from hemagglutinin__InfluenzaA__AEO01259

SEQ ID NO: 98868 - RNA, 1701 nt, Artificial Sequence; identical to SEQ ID NO: 96736
  derived and/or modified sequence opt2 from hemagglutinin__InfluenzaA__AEO01260

SEQ ID NO: 98869 - RNA, 1701 nt, Artificial Sequence
  derived and/or modified sequence opt2 from hemagglutinin__InfluenzaA__AEO01261
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccggcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98870 - RNA, 1701 nt, Artificial Sequence; identical to SEQ ID NO: 94181
  derived and/or modified sequence opt2 from hemagglutinin__InfluenzaA__AEO01262

SEQ ID NO: 98871 - RNA, 1701 nt, Artificial Sequence; identical to SEQ ID NO: 95863
  derived and/or modified sequence opt2 from hemagglutinin__InfluenzaA__AEO01263

SEQ ID NO: 98872 - RNA, 1701 nt, Artificial Sequence; identical to SEQ ID NO: 94534
  derived and/or modified sequence opt2 from hemagglutinin__InfluenzaA__AEO01264

SEQ ID NO: 98873 - RNA, 1701 nt, Artificial Sequence; identical to SEQ ID NO: 94181
  derived and/or modified sequence opt2 from hemagglutinin__InfluenzaA__AEO01265

SEQ ID NO: 98874 - RNA, 1701 nt, Artificial Sequence
  derived and/or modified sequence opt2 from hemagglutinin__InfluenzaA__AEO01266
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98875 - RNA, 1701 nt, Artificial Sequence; identical to SEQ ID NO: 94181
  derived and/or modified sequence opt2 from hemagglutinin__InfluenzaA__AEO01267

SEQ ID NO: 98876 - RNA, 1701 nt, Artificial Sequence; identical to SEQ ID NO: 94181
  derived and/or modified sequence opt2 from hemagglutinin__InfluenzaA__AEO01268

SEQ ID NO: 98877 - RNA, 1701 nt, Artificial Sequence
  derived and/or modified sequence opt2 from hemagglutinin__InfluenzaA__AEO01269
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcauggagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98878 - RNA, 1701 nt, Artificial Sequence; identical to SEQ ID NO: 95345
  derived and/or modified sequence opt2 from hemagglutinin__InfluenzaA__AEO01270

SEQ ID NO: 98879 - RNA, 1701 nt, Artificial Sequence
  derived and/or modified sequence opt2 from hemagglutinin__InfluenzaA__AEO01271
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98880 - RNA, 1701 nt, Artificial Sequence; identical to SEQ ID NO: 94181
  derived and/or modified sequence opt2 from hemagglutinin__InfluenzaA__AEO01272

SEQ ID NO: 98881 - RNA, 1701 nt, Artificial Sequence; identical to SEQ ID NO: 94181
  derived and/or modified sequence opt2 from hemagglutinin__InfluenzaA__AEO01273

SEQ ID NO: 98882 - RNA, 1701 nt, Artificial Sequence; identical to SEQ ID NO: 94181
  derived and/or modified sequence opt2 from hemagglutinin__InfluenzaA__AEO01274

SEQ ID NO: 98883 - RNA, 1701 nt, Artificial Sequence; identical to SEQ ID NO: 96349
  derived and/or modified sequence opt2 from hemagglutinin__InfluenzaA__AEO01275

SEQ ID NO: 98884 - RNA, 1701 nt, Artificial Sequence
  derived and/or modified sequence opt2 from hemagglutinin__InfluenzaA__AEO01276
augaaggccauccucgucguccuccucuacaccuucgccaccgccaacgccgacacccucugcaucggcuaccacgccaacaacuccaccgacaccgucgacaccguccucaagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccgaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98885 - RNA, 1701 nt, Artificial Sequence; identical to SEQ ID NO: 94181
  derived and/or modified sequence opt2 from hemagglutinin__InfluenzaA__AEO01277

SEQ ID NO: 98886 - RNA, 1701 nt, Artificial Sequence
  derived and/or modified sequence opt2 from hemagglutinin__InfluenzaA__AEO01278
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgccaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98887 - RNA, 1701 nt, Artificial Sequence
  derived and/or modified sequence opt2 from hemagglutinin__InfluenzaA__AEO01279
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98888 - RNA, 1701 nt, Artificial Sequence
  derived and/or modified sequence opt2 from hemagglutinin__InfluenzaA__AEO01282
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98889 - RNA, 1701 nt, Artificial Sequence; identical to SEQ ID NO: 95283
  derived and/or modified sequence opt2 from hemagglutinin__InfluenzaA__AEO01283

SEQ ID NO: 98890 - RNA, 1701 nt, Artificial Sequence
  derived and/or modified sequence opt2 from hemagglutinin__InfluenzaA__AEO01284
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98891 - RNA, 1701 nt, Artificial Sequence; identical to SEQ ID NO: 95282
  derived and/or modified sequence opt2 from hemagglutinin__InfluenzaA__AEO01285

SEQ ID NO: 98892 - RNA, 1701 nt, Artificial Sequence; identical to SEQ ID NO: 95375
  derived and/or modified sequence opt2 from hemagglutinin__InfluenzaA__AEO01286

SEQ ID NO: 98893 - RNA, 1701 nt, Artificial Sequence
  derived and/or modified sequence opt2 from hemagglutinin__InfluenzaA__AEO01287
augaaggccauccucgucguccuccucuacaccuucgccaccgccaacuccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98894 - RNA, 1701 nt, Artificial Sequence; identical to SEQ ID NO: 94534
  derived and/or modified sequence opt2 from hemagglutinin__InfluenzaA__AEO01288

SEQ ID NO: 98895 - RNA, 1701 nt, Artificial Sequence; identical to SEQ ID NO: 94181
  derived and/or modified sequence opt2 from hemagglutinin__InfluenzaA__AEO01289

SEQ ID NO: 98896 - RNA, 1701 nt, Artificial Sequence
  derived and/or modified sequence opt2 from hemagglutinin__InfluenzaA__AEO01290
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccucuccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98897 - RNA, 1701 nt, Artificial Sequence; identical to SEQ ID NO: 94181
  derived and/or modified sequence opt2 from hemagglutinin__InfluenzaA__AEO01291

SEQ ID NO: 98898 - RNA, 1701 nt, Artificial Sequence; identical to SEQ ID NO: 94181
  derived and/or modified sequence opt2 from hemagglutinin__InfluenzaA__AEO01292

SEQ ID NO: 98899 - RNA, 1701 nt, Artificial Sequence
  derived and/or modified sequence opt2 from hemagglutinin__InfluenzaA__AEO01294
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98900 - RNA, 1701 nt, Artificial Sequence
  derived and/or modified sequence opt2 from hemagglutinin__InfluenzaA__AEO01295
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacuacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98901 - RNA, 1701 nt, Artificial Sequence; identical to SEQ ID NO: 94181
  derived and/or modified sequence opt2 from hemagglutinin__InfluenzaA__AEO01296

SEQ ID NO: 98902 - RNA, 1701 nt, Artificial Sequence; identical to SEQ ID NO: 95863
  derived and/or modified sequence opt2 from hemagglutinin__InfluenzaA__AEO01297

SEQ ID NO: 98903 - RNA, 1701 nt, Artificial Sequence; identical to SEQ ID NO: 95868
  derived and/or modified sequence opt2 from hemagglutinin__InfluenzaA__AEO01298

SEQ ID NO: 98904 - RNA, 1701 nt, Artificial Sequence; identical to SEQ ID NO: 94181
  derived and/or modified sequence opt2 from hemagglutinin__InfluenzaA__AEO01299

SEQ ID NO: 98905 - RNA, 1701 nt, Artificial Sequence; identical to SEQ ID NO: 94181
  derived and/or modified sequence opt2 from hemagglutinin__InfluenzaA__AEO01300

SEQ ID NO: 98906 - RNA, 1701 nt, Artificial Sequence; identical to SEQ ID NO: 94181
  derived and/or modified sequence opt2 from hemagglutinin__InfluenzaA__AEO01301

SEQ ID NO: 98907 - RNA, 1701 nt, Artificial Sequence; identical to SEQ ID NO: 94181
  derived and/or modified sequence opt2 from hemagglutinin__InfluenzaA__AEO01302

SEQ ID NO: 98908 - RNA, 1701 nt, Artificial Sequence; identical to SEQ ID NO: 95778
  derived and/or modified sequence opt2 from hemagglutinin__InfluenzaA__AEO01303

SEQ ID NO: 98909 - RNA, 1701 nt, Artificial Sequence
  derived and/or modified sequence opt2 from hemagglutinin__InfluenzaA__AEO01304
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaagggcguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98910 - RNA, 1701 nt, Artificial Sequence
  derived and/or modified sequence opt2 from hemagglutinin__InfluenzaA__AEO01305
augaaggccauccucgucguccuccucuacaccuucgccaccgccuccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98911 - RNA, 1701 nt, Artificial Sequence; identical to SEQ ID NO: 94181
  derived and/or modified sequence opt2 from hemagglutinin__InfluenzaA__AEO01306

SEQ ID NO: 98912 - RNA, 1701 nt, Artificial Sequence; identical to SEQ ID NO: 94181
  derived and/or modified sequence opt2 from hemagglutinin__InfluenzaA__AEO01307

SEQ ID NO: 98913 - RNA, 1701 nt, Artificial Sequence; identical to SEQ ID NO: 94181
  derived and/or modified sequence opt2 from hemagglutinin__InfluenzaA__AEO01308

SEQ ID NO: 98914 - RNA, 1701 nt, Artificial Sequence
  derived and/or modified sequence opt2 from hemagglutinin__InfluenzaA__AEO01309
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98915 - RNA, 1701 nt, Artificial Sequence
  derived and/or modified sequence opt2 from hemagglutinin__InfluenzaA__AEO01310
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgaccgcggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98916 - RNA, 1701 nt, Artificial Sequence; identical to SEQ ID NO: 94181
  derived and/or modified sequence opt2 from hemagglutinin__InfluenzaA__AEO01311

SEQ ID NO: 98917 - RNA, 1701 nt, Artificial Sequence
  derived and/or modified sequence opt2 from hemagglutinin__InfluenzaA__AEO01312
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcaucgucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98918 - RNA, 1701 nt, Artificial Sequence; identical to SEQ ID NO: 94534
  derived and/or modified sequence opt2 from hemagglutinin__InfluenzaA__AEO01313

SEQ ID NO: 98919 - RNA, 1701 nt, Artificial Sequence; identical to SEQ ID NO: 95345
  derived and/or modified sequence opt2 from hemagglutinin__InfluenzaA__AEO01314

SEQ ID NO: 98920 - RNA, 1701 nt, Artificial Sequence
  derived and/or modified sequence opt2 from hemagglutinin__InfluenzaA__AEO01315
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaaccgcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98921 - RNA, 1701 nt, Artificial Sequence; identical to SEQ ID NO: 94181
  derived and/or modified sequence opt2 from hemagglutinin__InfluenzaA__AEO01316

SEQ ID NO: 98922 - RNA, 1701 nt, Artificial Sequence; identical to SEQ ID NO: 94181
  derived and/or modified sequence opt2 from hemagglutinin__InfluenzaA__AEO01317

SEQ ID NO: 98923 - RNA, 1701 nt, Artificial Sequence; identical to SEQ ID NO: 94181
  derived and/or modified sequence opt2 from hemagglutinin__InfluenzaA__AEO01318

SEQ ID NO: 98924 - RNA, 1701 nt, Artificial Sequence; identical to SEQ ID NO: 94181
  derived and/or modified sequence opt2 from hemagglutinin__InfluenzaA__AEO01319

SEQ ID NO: 98925 - RNA, 1701 nt, Artificial Sequence
  derived and/or modified sequence opt2 from hemagglutinin__InfluenzaA__AEO01321
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgcccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98926 - RNA, 1701 nt, Artificial Sequence; identical to SEQ ID NO: 94181
  derived and/or modified sequence opt2 from hemagglutinin__InfluenzaA__AEO01322

SEQ ID NO: 98927 - RNA, 1701 nt, Artificial Sequence; identical to SEQ ID NO: 95863
  derived and/or modified sequence opt2 from hemagglutinin__InfluenzaA__AEO01323

SEQ ID NO: 98928 - RNA, 1701 nt, Artificial Sequence; identical to SEQ ID NO: 95778
  derived and/or modified sequence opt2 from hemagglutinin__InfluenzaA__AEO01324

SEQ ID NO: 98929 - RNA, 1701 nt, Artificial Sequence; identical to SEQ ID NO: 94181
  derived and/or modified sequence opt2 from hemagglutinin__InfluenzaA__AEO01325

SEQ ID NO: 98930 - RNA, 1701 nt, Artificial Sequence
  derived and/or modified sequence opt2 from hemagglutinin__InfluenzaA__AEO01326
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccaggacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98931 - RNA, 1701 nt, Artificial Sequence; identical to SEQ ID NO: 94181
  derived and/or modified sequence opt2 from hemagglutinin__InfluenzaA__AEO01327

SEQ ID NO: 98932 - RNA, 1701 nt, Artificial Sequence; identical to SEQ ID NO: 98890
  derived and/or modified sequence opt2 from hemagglutinin__InfluenzaA__AEO01328

SEQ ID NO: 98933 - RNA, 1701 nt, Artificial Sequence; identical to SEQ ID NO: 94181
  derived and/or modified sequence opt2 from hemagglutinin__InfluenzaA__AEO01330

SEQ ID NO: 98934 - RNA, 1701 nt, Artificial Sequence
  derived and/or modified sequence opt2 from hemagglutinin__InfluenzaA__AEO01331
augaaggccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98935 - RNA, 1701 nt, Artificial Sequence
  derived and/or modified sequence opt2 from hemagglutinin__InfluenzaA__AEO01332
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggccucucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucgucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcauggagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98936 - RNA, 1701 nt, Artificial Sequence; identical to SEQ ID NO: 96349
  derived and/or modified sequence opt2 from hemagglutinin__InfluenzaA__AEO01333

SEQ ID NO: 98937 - RNA, 1701 nt, Artificial Sequence
  derived and/or modified sequence opt2 from hemagglutinin__InfluenzaA__AEO01334
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98938 - RNA, 1701 nt, Artificial Sequence; identical to SEQ ID NO: 95778
  derived and/or modified sequence opt2 from hemagglutinin__InfluenzaA__AEO01335

SEQ ID NO: 98939 - RNA, 1701 nt, Artificial Sequence
  derived and/or modified sequence opt2 from hemagglutinin__InfluenzaA__AEO01336
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98940 - RNA, 1701 nt, Artificial Sequence
  derived and/or modified sequence opt2 from hemagglutinin__InfluenzaA__AEO01337
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98941 - RNA, 1701 nt, Artificial Sequence; identical to SEQ ID NO: 94181
  derived and/or modified sequence opt2 from hemagglutinin__InfluenzaA__AEO01338

SEQ ID NO: 98942 - RNA, 1701 nt, Artificial Sequence; identical to SEQ ID NO: 98053
  derived and/or modified sequence opt2 from hemagglutinin__InfluenzaA__AEO01339

SEQ ID NO: 98943 - RNA, 1701 nt, Artificial Sequence; identical to SEQ ID NO: 98899
  derived and/or modified sequence opt2 from hemagglutinin__InfluenzaA__AEO01340

SEQ ID NO: 98944 - RNA, 1701 nt, Artificial Sequence; identical to SEQ ID NO: 98899
  derived and/or modified sequence opt2 from hemagglutinin__InfluenzaA__AEO01341

SEQ ID NO: 98945 - RNA, 1701 nt, Artificial Sequence; identical to SEQ ID NO: 94181
  derived and/or modified sequence opt2 from hemagglutinin__InfluenzaA__AEO01342

SEQ ID NO: 98946 - RNA, 1701 nt, Artificial Sequence
  derived and/or modified sequence opt2 from hemagglutinin__InfluenzaA__AEO01343
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98947 - RNA, 1701 nt, Artificial Sequence
  derived and/or modified sequence opt2 from hemagglutinin__InfluenzaA__AEO01344
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98948 - RNA, 1701 nt, Artificial Sequence; identical to SEQ ID NO: 98053
  derived and/or modified sequence opt2 from hemagglutinin__InfluenzaA__AEO01345

SEQ ID NO: 98949 - RNA, 1701 nt, Artificial Sequence; identical to SEQ ID NO: 94181
  derived and/or modified sequence opt2 from hemagglutinin__InfluenzaA__AEO01346

SEQ ID NO: 98950 - RNA, 1701 nt, Artificial Sequence
  derived and/or modified sequence opt2 from hemagglutinin__InfluenzaA__AEO01347
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98951 - RNA, 1701 nt, Artificial Sequence
  derived and/or modified sequence opt2 from hemagglutinin__InfluenzaA__AEO01348
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98952 - RNA, 1701 nt, Artificial Sequence
  derived and/or modified sequence opt2 from hemagglutinin__InfluenzaA__AEO01349
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgagaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98953 - RNA, 1701 nt, Artificial Sequence
  derived and/or modified sequence opt2 from hemagglutinin__InfluenzaA__AEO01350
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98954 - RNA, 1701 nt, Artificial Sequence; identical to SEQ ID NO: 94181
  derived and/or modified sequence opt2 from hemagglutinin__InfluenzaA__AEO01351

SEQ ID NO: 98955 - RNA, 1701 nt, Artificial Sequence; identical to SEQ ID NO: 95345
  derived and/or modified sequence opt2 from hemagglutinin__InfluenzaA__AEO01352

SEQ ID NO: 98956 - RNA, 1701 nt, Artificial Sequence
  derived and/or modified sequence opt2 from hemagglutinin__InfluenzaA__AEO01353
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucuuccucggcgccaucuccuucuggaugugcuccaacggcucccuccagugccgcaucugcaucuga

SEQ ID NO: 98957 - RNA, 1701 nt, Artificial Sequence
  derived and/or modified sequence opt2 from hemagglutinin__InfluenzaA__AEO01354
augaaggccauccucgucguccuccucuacaaguucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98958 - RNA, 1701 nt, Artificial Sequence; identical to SEQ ID NO: 95601
  derived and/or modified sequence opt2 from hemagglutinin__InfluenzaA__AEO01355

SEQ ID NO: 98959 - RNA, 1701 nt, Artificial Sequence; identical to SEQ ID NO: 94181
  derived and/or modified sequence opt2 from hemagglutinin__InfluenzaA__AEO01356

SEQ ID NO: 98960 - RNA, 1701 nt, Artificial Sequence
  derived and/or modified sequence opt2 from hemagglutinin__InfluenzaA__AEO01358
augaaggccauccucgucguccuccucuacaccuucgccaccgccaacgccgacacccucugcgucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98961 - RNA, 1701 nt, Artificial Sequence; identical to SEQ ID NO: 95601
  derived and/or modified sequence opt2 from hemagglutinin__InfluenzaA__AEO01359

SEQ ID NO: 98962 - RNA, 1701 nt, Artificial Sequence; identical to SEQ ID NO: 98934
  derived and/or modified sequence opt2 from hemagglutinin__InfluenzaA__AEO01360

SEQ ID NO: 98963 - RNA, 1701 nt, Artificial Sequence; identical to SEQ ID NO: 94534
  derived and/or modified sequence opt2 from hemagglutinin__InfluenzaA__AEO01361

SEQ ID NO: 98964 - RNA, 1701 nt, Artificial Sequence; identical to SEQ ID NO: 98934
  derived and/or modified sequence opt2 from hemagglutinin__InfluenzaA__AEO01362

SEQ ID NO: 98965 - RNA, 1701 nt, Artificial Sequence; identical to SEQ ID NO: 95345
  derived and/or modified sequence opt2 from hemagglutinin__InfluenzaA__AEO01363

SEQ ID NO: 98966 - RNA, 1701 nt, Artificial Sequence
  derived and/or modified sequence opt2 from hemagglutinin__InfluenzaA__AEO01365
augaaggccauccucgucguccuccucuacaccuucgccaccgccaacgccgacacccucugcaucggcuaccacgccaacaacuccaccgacaccgucgacaccguccucaagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcuccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98967 - RNA, 1701 nt, Artificial Sequence
  derived and/or modified sequence opt2 from hemagglutinin__InfluenzaA__AEO01366
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcuccaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98968 - RNA, 1701 nt, Artificial Sequence; identical to SEQ ID NO: 98939
  derived and/or modified sequence opt2 from hemagglutinin__InfluenzaA__AEO01367

SEQ ID NO: 98969 - RNA, 1701 nt, Artificial Sequence
  derived and/or modified sequence opt2 from hemagglutinin__InfluenzaA__AEO01368
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98970 - RNA, 1701 nt, Artificial Sequence; identical to SEQ ID NO: 94181
  derived and/or modified sequence opt2 from hemagglutinin__InfluenzaA__AEO01369

SEQ ID NO: 98971 - RNA, 1701 nt, Artificial Sequence; identical to SEQ ID NO: 98899
  derived and/or modified sequence opt2 from hemagglutinin__InfluenzaA__AEO01370

SEQ ID NO: 98972 - RNA, 1701 nt, Artificial Sequence; identical to SEQ ID NO: 98946
  derived and/or modified sequence opt2 from hemagglutinin__InfluenzaA__AEO01371

SEQ ID NO: 98973 - RNA, 1701 nt, Artificial Sequence; identical to SEQ ID NO: 95778
  derived and/or modified sequence opt2 from hemagglutinin__InfluenzaA__AEO01372

SEQ ID NO: 98974 - RNA, 1701 nt, Artificial Sequence; identical to SEQ ID NO: 95778
  derived and/or modified sequence opt2 from hemagglutinin__InfluenzaA__AEO01373

SEQ ID NO: 98975 - RNA, 1701 nt, Artificial Sequence
  derived and/or modified sequence opt2 from hemagglutinin__InfluenzaA__AEO01374
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacaucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98976 - RNA, 1701 nt, Artificial Sequence; identical to SEQ ID NO: 98950
  derived and/or modified sequence opt2 from hemagglutinin__InfluenzaA__AEO01375

SEQ ID NO: 98977 - RNA, 1701 nt, Artificial Sequence; identical to SEQ ID NO: 94181
  derived and/or modified sequence opt2 from hemagglutinin__InfluenzaA__AEO01376

SEQ ID NO: 98978 - RNA, 1701 nt, Artificial Sequence; identical to SEQ ID NO: 96349
  derived and/or modified sequence opt2 from hemagglutinin__InfluenzaA__AEO01377

SEQ ID NO: 98979 - RNA, 1701 nt, Artificial Sequence
  derived and/or modified sequence opt2 from hemagglutinin__InfluenzaA__AEO01378
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98980 - RNA, 1701 nt, Artificial Sequence; identical to SEQ ID NO: 95345
  derived and/or modified sequence opt2 from hemagglutinin__InfluenzaA__AEO01379

SEQ ID NO: 98981 - RNA, 1701 nt, Artificial Sequence; identical to SEQ ID NO: 98950
  derived and/or modified sequence opt2 from hemagglutinin__InfluenzaA__AEO01380

SEQ ID NO: 98982 - RNA, 1701 nt, Artificial Sequence; identical to SEQ ID NO: 98950
  derived and/or modified sequence opt2 from hemagglutinin__InfluenzaA__AEO01381

SEQ ID NO: 98983 - RNA, 1701 nt, Artificial Sequence; identical to SEQ ID NO: 95345
  derived and/or modified sequence opt2 from hemagglutinin__InfluenzaA__AEO01382

SEQ ID NO: 98984 - RNA, 1701 nt, Artificial Sequence; identical to SEQ ID NO: 95778
  derived and/or modified sequence opt2 from hemagglutinin__InfluenzaA__AEO01383

SEQ ID NO: 98985 - RNA, 1701 nt, Artificial Sequence
  derived and/or modified sequence opt2 from hemagglutinin__InfluenzaA__AEO01384
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98986 - RNA, 1701 nt, Artificial Sequence
  derived and/or modified sequence opt2 from hemagglutinin__InfluenzaA__AEO01385
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccaacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98987 - RNA, 1701 nt, Artificial Sequence; identical to SEQ ID NO: 98890
  derived and/or modified sequence opt2 from hemagglutinin__InfluenzaA__AEO01386

SEQ ID NO: 98988 - RNA, 1701 nt, Artificial Sequence
  derived and/or modified sequence opt2 from hemagglutinin__InfluenzaA__AEO01387
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98989 - RNA, 1701 nt, Artificial Sequence
  derived and/or modified sequence opt2 from hemagglutinin__InfluenzaA__AEO01388
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98990 - RNA, 1701 nt, Artificial Sequence
  derived and/or modified sequence opt2 from hemagglutinin__InfluenzaA__AEO01389
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcaccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98991 - RNA, 1701 nt, Artificial Sequence
  derived and/or modified sequence opt2 from hemagglutinin__InfluenzaA__AEO01390
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucgagaccucccgcuacuccaagaaggucaagcccgagaucgccauccgcccccgcguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggucgccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98992 - RNA, 1701 nt, Artificial Sequence; identical to SEQ ID NO: 98890
  derived and/or modified sequence opt2 from hemagglutinin__InfluenzaA__AEO01391

SEQ ID NO: 98993 - RNA, 1701 nt, Artificial Sequence; identical to SEQ ID NO: 98899
  derived and/or modified sequence opt2 from hemagglutinin__InfluenzaA__AEO01392

SEQ ID NO: 98994 - RNA, 1701 nt, Artificial Sequence; identical to SEQ ID NO: 95778
  derived and/or modified sequence opt2 from hemagglutinin__InfluenzaA__AEO01393

SEQ ID NO: 98995 - RNA, 1701 nt, Artificial Sequence; identical to SEQ ID NO: 95282
  derived and/or modified sequence opt2 from hemagglutinin__InfluenzaA__AEO01394

SEQ ID NO: 98996 - RNA, 1701 nt, Artificial Sequence
  derived and/or modified sequence opt2 from hemagglutinin__InfluenzaA__AEO01395
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuuccucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98997 - RNA, 1701 nt, Artificial Sequence; identical to SEQ ID NO: 95282
  derived and/or modified sequence opt2 from hemagglutinin__InfluenzaA__AEO01396

SEQ ID NO: 98998 - RNA, 1701 nt, Artificial Sequence
  derived and/or modified sequence opt2 from hemagglutinin__InfluenzaA__AEO01397
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacaccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 98999 - RNA, 1701 nt, Artificial Sequence
  derived and/or modified sequence opt2 from hemagglutinin__InfluenzaA__AEO01398
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccaacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99000 - RNA, 1701 nt, Artificial Sequence; identical to SEQ ID NO: 98899
  derived and/or modified sequence opt2 from hemagglutinin__InfluenzaA__AEO01399

SEQ ID NO: 99001 - RNA, 1701 nt, Artificial Sequence; identical to SEQ ID NO: 94181
  derived and/or modified sequence opt2 from hemagglutinin__InfluenzaA__AEO01402

SEQ ID NO: 99002 - RNA, 1701 nt, Artificial Sequence; identical to SEQ ID NO: 95345
  derived and/or modified sequence opt2 from hemagglutinin__InfluenzaA__AEO01403

SEQ ID NO: 99003 - RNA, 1701 nt, Artificial Sequence; identical to SEQ ID NO: 94181
  derived and/or modified sequence opt2 from hemagglutinin__InfluenzaA__AEO01404

SEQ ID NO: 99004 - RNA, 1701 nt, Artificial Sequence
  derived and/or modified sequence opt2 from hemagglutinin__InfluenzaA__AEO01405
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucgucgucucccucggcgccaucuccuucuggaugugcuccaacggcucccuccagugccgcaucugcaucuga

SEQ ID NO: 99005 - RNA, 1701 nt, Artificial Sequence
  derived and/or modified sequence opt2 from hemagglutinin__InfluenzaA__AEO01407
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99006 - RNA, 1701 nt, Artificial Sequence
  derived and/or modified sequence opt2 from hemagglutinin__InfluenzaA__AEO01408
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99007 - RNA, 1701 nt, Artificial Sequence; identical to SEQ ID NO: 95283
  derived and/or modified sequence opt2 from hemagglutinin__InfluenzaA__AEO01409

SEQ ID NO: 99008 - RNA, 1701 nt, Artificial Sequence; identical to SEQ ID NO: 98899
  derived and/or modified sequence opt2 from hemagglutinin__InfluenzaA__AEO01410

SEQ ID NO: 99009 - RNA, 1701 nt, Artificial Sequence; identical to SEQ ID NO: 97600
  derived and/or modified sequence opt2 from hemagglutinin__InfluenzaA__AEO01411

SEQ ID NO: 99010 - RNA, 1701 nt, Artificial Sequence; identical to SEQ ID NO: 94534
  derived and/or modified sequence opt2 from hemagglutinin__InfluenzaA__AEO01412

SEQ ID NO: 99011 - RNA, 1701 nt, Artificial Sequence
  derived and/or modified sequence opt2 from hemagglutinin__InfluenzaA__AEO01413
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaaguccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99012 - RNA, 1701 nt, Artificial Sequence
  derived and/or modified sequence opt2 from hemagglutinin__InfluenzaA__AEO01414
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcuccaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99013 - RNA, 1701 nt, Artificial Sequence; identical to SEQ ID NO: 97812
  derived and/or modified sequence opt2 from hemagglutinin__InfluenzaA__AEO01416

SEQ ID NO: 99014 - RNA, 1701 nt, Artificial Sequence; identical to SEQ ID NO: 95345
  derived and/or modified sequence opt2 from hemagglutinin__InfluenzaA__AEO01418

SEQ ID NO: 99015 - RNA, 1701 nt, Artificial Sequence; identical to SEQ ID NO: 95345
  derived and/or modified sequence opt2 from hemagglutinin__InfluenzaA__AEO01419

SEQ ID NO: 99016 - RNA, 1701 nt, Artificial Sequence
  derived and/or modified sequence opt2 from hemagglutinin__InfluenzaA__AEO01420
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaguacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99017 - RNA, 1701 nt, Artificial Sequence
  derived and/or modified sequence opt2 from hemagglutinin__InfluenzaA__AEO01421
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99018 - RNA, 1701 nt, Artificial Sequence
  derived and/or modified sequence opt2 from hemagglutinin__InfluenzaA__AEO01422
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaaccucuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99019 - RNA, 1701 nt, Artificial Sequence
  derived and/or modified sequence opt2 from hemagglutinin__InfluenzaA__AEO01423
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucaccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99020 - RNA, 1701 nt, Artificial Sequence; identical to SEQ ID NO: 99017
  derived and/or modified sequence opt2 from hemagglutinin__InfluenzaA__AEO01424

SEQ ID NO: 99021 - RNA, 1701 nt, Artificial Sequence; identical to SEQ ID NO: 99017
  derived and/or modified sequence opt2 from hemagglutinin__InfluenzaA__AEO01425

SEQ ID NO: 99022 - RNA, 1701 nt, Artificial Sequence; identical to SEQ ID NO: 94181
  derived and/or modified sequence opt2 from hemagglutinin__InfluenzaA__AEO01426

SEQ ID NO: 99023 - RNA, 1701 nt, Artificial Sequence
  derived and/or modified sequence opt2 from hemagglutinin__InfluenzaA__AEO01427
augaaggccauccucgucguccuccucuacaccuucgccaccgccaacuccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99024 - RNA, 1701 nt, Artificial Sequence
  derived and/or modified sequence opt2 from hemagglutinin__InfluenzaA__AEO01428
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99025 - RNA, 1701 nt, Artificial Sequence; identical to SEQ ID NO: 95345
  derived and/or modified sequence opt2 from hemagglutinin__InfluenzaA__AEO01429

SEQ ID NO: 99026 - RNA, 1701 nt, Artificial Sequence
  derived and/or modified sequence opt2 from hemagglutinin__InfluenzaA__AEO01430
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgacggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99027 - RNA, 1701 nt, Artificial Sequence; identical to SEQ ID NO: 98899
  derived and/or modified sequence opt2 from hemagglutinin__InfluenzaA__AEO01431

SEQ ID NO: 99028 - RNA, 1701 nt, Artificial Sequence; identical to SEQ ID NO: 94181
  derived and/or modified sequence opt2 from hemagglutinin__InfluenzaA__AEO01432

SEQ ID NO: 99029 - RNA, 1701 nt, Artificial Sequence
  derived and/or modified sequence opt2 from hemagglutinin__InfluenzaA__AEO01434
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcgagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99030 - RNA, 1701 nt, Artificial Sequence
  derived and/or modified sequence opt2 from hemagglutinin__InfluenzaA__AEO01435
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucuacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99031 - RNA, 1701 nt, Artificial Sequence; identical to SEQ ID NO: 99017
  derived and/or modified sequence opt2 from hemagglutinin__InfluenzaA__AEO01436

SEQ ID NO: 99032 - RNA, 1701 nt, Artificial Sequence; identical to SEQ ID NO: 98899
  derived and/or modified sequence opt2 from hemagglutinin__InfluenzaA__AEO01437

SEQ ID NO: 99033 - RNA, 1701 nt, Artificial Sequence; identical to SEQ ID NO: 98950
  derived and/or modified sequence opt2 from hemagglutinin__InfluenzaA__AEO01438

SEQ ID NO: 99034 - RNA, 1701 nt, Artificial Sequence; identical to SEQ ID NO: 94534
  derived and/or modified sequence opt2 from hemagglutinin__InfluenzaA__AEO01440

SEQ ID NO: 99035 - RNA, 1701 nt, Artificial Sequence
  derived and/or modified sequence opt2 from hemagglutinin__InfluenzaA__AEO01441
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgacggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99036 - RNA, 1701 nt, Artificial Sequence; identical to SEQ ID NO: 95601
  derived and/or modified sequence opt2 from hemagglutinin__InfluenzaA__AEO01442

SEQ ID NO: 99037 - RNA, 1701 nt, Artificial Sequence
  derived and/or modified sequence opt2 from hemagglutinin__InfluenzaA__AEO01443
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99038 - RNA, 1701 nt, Artificial Sequence
  derived and/or modified sequence opt2 from hemagglutinin__InfluenzaA__AEO01444
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99039 - RNA, 1701 nt, Artificial Sequence; identical to SEQ ID NO: 96349
  derived and/or modified sequence opt2 from hemagglutinin__InfluenzaA__AEO01445

SEQ ID NO: 99040 - RNA, 1701 nt, Artificial Sequence; identical to SEQ ID NO: 98899
  derived and/or modified sequence opt2 from hemagglutinin__InfluenzaA__AEO01446

SEQ ID NO: 99041 - RNA, 1701 nt, Artificial Sequence
  derived and/or modified sequence opt2 from hemagglutinin__InfluenzaA__AEO01447
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccaucgccuccucccucguccucgucgucucccucggcgccaucuccuucuggaugugcuccaacggcucccuccagugccgcaucugcaucuga

SEQ ID NO: 99042 - RNA, 1701 nt, Artificial Sequence; identical to SEQ ID NO: 94534
  derived and/or modified sequence opt2 from hemagglutinin__InfluenzaA__AEO01448

SEQ ID NO: 99043 - RNA, 1701 nt, Artificial Sequence; identical to SEQ ID NO: 99017
  derived and/or modified sequence opt2 from hemagglutinin__InfluenzaA__AEO01449

SEQ ID NO: 99044 - RNA, 1701 nt, Artificial Sequence
  derived and/or modified sequence opt2 from hemagglutinin__InfluenzaA__AEO01450
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99045 - RNA, 1701 nt, Artificial Sequence; identical to SEQ ID NO: 94181
  derived and/or modified sequence opt2 from hemagglutinin__InfluenzaA__AEO01451

SEQ ID NO: 99046 - RNA, 1701 nt, Artificial Sequence
  derived and/or modified sequence opt2 from hemagglutinin__InfluenzaA__AEO01452
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99047 - RNA, 1701 nt, Artificial Sequence
  derived and/or modified sequence opt2 from hemagglutinin__InfluenzaA__AEO01453
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcguccaccaccccuccaccuccgccgaccagcagucccucuaccagaacgccgacgccuacgucuucgucggcaccucccgcuacuccaagaaguucaagcgcgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99048 - RNA, 1701 nt, Artificial Sequence
  derived and/or modified sequence opt2 from hemagglutinin__InfluenzaA__AEO01454
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaccaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99049 - RNA, 1701 nt, Artificial Sequence
  derived and/or modified sequence opt2 from hemagglutinin__InfluenzaA__AEO01455
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99050 - RNA, 1701 nt, Artificial Sequence
  derived and/or modified sequence opt2 from hemagglutinin__InfluenzaA__AEO01456
augaaggccauccucaucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggaccgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99051 - RNA, 1701 nt, Artificial Sequence; identical to SEQ ID NO: 98950
  derived and/or modified sequence opt2 from hemagglutinin__InfluenzaA__AEO01457

SEQ ID NO: 99052 - RNA, 1701 nt, Artificial Sequence; identical to SEQ ID NO: 98946
  derived and/or modified sequence opt2 from hemagglutinin__InfluenzaA__AEO01458

SEQ ID NO: 99053 - RNA, 1701 nt, Artificial Sequence; identical to SEQ ID NO: 98946
  derived and/or modified sequence opt2 from hemagglutinin__InfluenzaA__AEO01459

SEQ ID NO: 99054 - RNA, 1701 nt, Artificial Sequence; identical to SEQ ID NO: 95601
  derived and/or modified sequence opt2 from hemagglutinin__InfluenzaA__AEO01461

SEQ ID NO: 99055 - RNA, 1701 nt, Artificial Sequence; identical to SEQ ID NO: 95282
  derived and/or modified sequence opt2 from hemagglutinin__InfluenzaA__AEO01462

SEQ ID NO: 99056 - RNA, 1701 nt, Artificial Sequence; identical to SEQ ID NO: 94534
  derived and/or modified sequence opt2 from hemagglutinin__InfluenzaA__AEO01463

SEQ ID NO: 99057 - RNA, 1701 nt, Artificial Sequence
  derived and/or modified sequence opt2 from hemagglutinin__InfluenzaA__AEO01464
augaaggccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggaccgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99058 - RNA, 1701 nt, Artificial Sequence; identical to SEQ ID NO: 99037
  derived and/or modified sequence opt2 from hemagglutinin__InfluenzaA__AEO01465

SEQ ID NO: 99059 - RNA, 1701 nt, Artificial Sequence; identical to SEQ ID NO: 96053
  derived and/or modified sequence opt2 from hemagglutinin__InfluenzaA__AEO01466

SEQ ID NO: 99060 - RNA, 1701 nt, Artificial Sequence; identical to SEQ ID NO: 94534
  derived and/or modified sequence opt2 from hemagglutinin__InfluenzaA__AEO01467

SEQ ID NO: 99061 - RNA, 1701 nt, Artificial Sequence; identical to SEQ ID NO: 95345
  derived and/or modified sequence opt2 from hemagglutinin__InfluenzaA__AEO01468

SEQ ID NO: 99062 - RNA, 1701 nt, Artificial Sequence; identical to SEQ ID NO: 94181
  derived and/or modified sequence opt2 from hemagglutinin__InfluenzaA__AEO01469

SEQ ID NO: 99063 - RNA, 1701 nt, Artificial Sequence
  derived and/or modified sequence opt2 from hemagglutinin__InfluenzaA__AEO01470
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucaucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99064 - RNA, 1701 nt, Artificial Sequence; identical to SEQ ID NO: 98890
  derived and/or modified sequence opt2 from hemagglutinin__InfluenzaA__AEO01471

SEQ ID NO: 99065 - RNA, 1701 nt, Artificial Sequence; identical to SEQ ID NO: 95808
  derived and/or modified sequence opt2 from hemagglutinin__InfluenzaA__AEO01472

SEQ ID NO: 99066 - RNA, 1701 nt, Artificial Sequence
  derived and/or modified sequence opt2 from hemagglutinin__InfluenzaA__AEO01473
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99067 - RNA, 1701 nt, Artificial Sequence
  derived and/or modified sequence opt2 from hemagglutinin__InfluenzaA__AEO01474
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99068 - RNA, 1701 nt, Artificial Sequence
  derived and/or modified sequence opt2 from hemagglutinin__InfluenzaA__AEO01475
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99069 - RNA, 1701 nt, Artificial Sequence
  derived and/or modified sequence opt2 from hemagglutinin__InfluenzaA__AEO01476
augaaggccauccucgucguccuccucuacaccuucuccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99070 - RNA, 1701 nt, Artificial Sequence
  derived and/or modified sequence opt2 from hemagglutinin__InfluenzaA__AEO01477
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99071 - RNA, 1701 nt, Artificial Sequence; identical to SEQ ID NO: 95509
  derived and/or modified sequence opt2 from hemagglutinin__InfluenzaA__AEO01478

SEQ ID NO: 99072 - RNA, 1701 nt, Artificial Sequence; identical to SEQ ID NO: 98899
  derived and/or modified sequence opt2 from hemagglutinin__InfluenzaA__AEO01479

SEQ ID NO: 99073 - RNA, 1701 nt, Artificial Sequence; identical to SEQ ID NO: 98946
  derived and/or modified sequence opt2 from hemagglutinin__InfluenzaA__AEO01480

SEQ ID NO: 99074 - RNA, 1701 nt, Artificial Sequence
  derived and/or modified sequence opt2 from hemagglutinin__InfluenzaA__AEO01482
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99075 - RNA, 1701 nt, Artificial Sequence
  derived and/or modified sequence opt2 from hemagglutinin__InfluenzaA__AEO01483
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 99076 - RNA, 1701 nt, Artificial Sequence
  derived and/or modified sequence opt2 from hemagglutinin__InfluenzaA__AEO01484
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99077 - RNA, 1701 nt, Artificial Sequence
  derived and/or modified sequence opt2 from hemagglutinin__InfluenzaA__AEO01485
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucaccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99078 - RNA, 1701 nt, Artificial Sequence
  derived and/or modified sequence opt2 from hemagglutinin__InfluenzaA__AEO01487
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucacccucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99079 - RNA, 1701 nt, Artificial Sequence
  derived and/or modified sequence opt2 from hemagglutinin__InfluenzaA__AEO01488
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99080 - RNA, 1701 nt, Artificial Sequence
  derived and/or modified sequence opt2 from hemagglutinin__InfluenzaA__AEO01489
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguuccgccccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99081 - RNA, 1701 nt, Artificial Sequence
  derived and/or modified sequence opt2 from hemagglutinin__InfluenzaA__AEO01490
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99082 - RNA, 1701 nt, Artificial Sequence
  derived and/or modified sequence opt2 from hemagglutinin__InfluenzaA__AEO01491
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaaguacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuaccacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99083 - RNA, 1701 nt, Artificial Sequence; identical to SEQ ID NO: 98950
  derived and/or modified sequence opt2 from hemagglutinin__InfluenzaA__AEO01492

SEQ ID NO: 99084 - RNA, 1701 nt, Artificial Sequence
  derived and/or modified sequence opt2 from hemagglutinin__InfluenzaA__AEO01493
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcuccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99085 - RNA, 1701 nt, Artificial Sequence
  derived and/or modified sequence opt2 from hemagglutinin__InfluenzaA__AEO01494
augaaggccauccucgucguccuccucuacaccuucgccaccgccaacgccgacacccucugcaccggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99086 - RNA, 1701 nt, Artificial Sequence; identical to SEQ ID NO: 95778
  derived and/or modified sequence opt2 from hemagglutinin__InfluenzaA__AEO01496

SEQ ID NO: 99087 - RNA, 1701 nt, Artificial Sequence; identical to SEQ ID NO: 94534
  derived and/or modified sequence opt2 from hemagglutinin__InfluenzaA__AEO01497

SEQ ID NO: 99088 - RNA, 1701 nt, Artificial Sequence; identical to SEQ ID NO: 95778
  derived and/or modified sequence opt2 from hemagglutinin__InfluenzaA__AEO01498

SEQ ID NO: 99089 - RNA, 1701 nt, Artificial Sequence
  derived and/or modified sequence opt2 from hemagglutinin__InfluenzaA__AEO01499
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuacaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99090 - RNA, 1701 nt, Artificial Sequence; identical to SEQ ID NO: 95282
  derived and/or modified sequence opt2 from hemagglutinin__InfluenzaA__AEO01500

SEQ ID NO: 99091 - RNA, 1701 nt, Artificial Sequence; identical to SEQ ID NO: 95345
  derived and/or modified sequence opt2 from hemagglutinin__InfluenzaA__AEO01501

SEQ ID NO: 99092 - RNA, 1701 nt, Artificial Sequence; identical to SEQ ID NO: 95345
  derived and/or modified sequence opt2 from hemagglutinin__InfluenzaA__AEO01502

SEQ ID NO: 99093 - RNA, 1701 nt, Artificial Sequence; identical to SEQ ID NO: 95601
  derived and/or modified sequence opt2 from hemagglutinin__InfluenzaA__AEO01503

SEQ ID NO: 99094 - RNA, 1701 nt, Artificial Sequence; identical to SEQ ID NO: 95778
  derived and/or modified sequence opt2 from hemagglutinin__InfluenzaA__AEO01505

SEQ ID NO: 99095 - RNA, 1701 nt, Artificial Sequence; identical to SEQ ID NO: 95282
  derived and/or modified sequence opt2 from hemagglutinin__InfluenzaA__AEO01506

SEQ ID NO: 99096 - RNA, 1701 nt, Artificial Sequence; identical to SEQ ID NO: 98890
  derived and/or modified sequence opt2 from hemagglutinin__InfluenzaA__AEO01507

SEQ ID NO: 99097 - RNA, 1701 nt, Artificial Sequence; identical to SEQ ID NO: 95778
  derived and/or modified sequence opt2 from hemagglutinin__InfluenzaA__AEO01508

SEQ ID NO: 99098 - RNA, 1701 nt, Artificial Sequence; identical to SEQ ID NO: 95509
  derived and/or modified sequence opt2 from hemagglutinin__InfluenzaA__AEO01510

SEQ ID NO: 99099 - RNA, 1701 nt, Artificial Sequence
  derived and/or modified sequence opt2 from hemagglutinin__InfluenzaA__AEO01511
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99100 - RNA, 1701 nt, Artificial Sequence
  derived and/or modified sequence opt2 from hemagglutinin__InfluenzaA__AEO01512
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaagugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99101 - RNA, 1701 nt, Artificial Sequence
  derived and/or modified sequence opt2 from hemagglutinin__InfluenzaA__AEO01513
augaaggccauccucgccguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccgucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99102 - RNA, 1701 nt, Artificial Sequence
  derived and/or modified sequence opt2 from hemagglutinin__InfluenzaA__AEO01514
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaugcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99103 - RNA, 1701 nt, Artificial Sequence; identical to SEQ ID NO: 96368
  derived and/or modified sequence opt2 from hemagglutinin__InfluenzaA__AEO01515

SEQ ID NO: 99104 - RNA, 1701 nt, Artificial Sequence; identical to SEQ ID NO: 98950
  derived and/or modified sequence opt2 from hemagglutinin__InfluenzaA__AEO01516

SEQ ID NO: 99105 - RNA, 1701 nt, Artificial Sequence
  derived and/or modified sequence opt2 from hemagglutinin__InfluenzaA__AEO01517
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99106 - RNA, 1701 nt, Artificial Sequence
  derived and/or modified sequence opt2 from hemagglutinin__InfluenzaA__AEO01518
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggaucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99107 - RNA, 1701 nt, Artificial Sequence
  derived and/or modified sequence opt2 from hemagglutinin__InfluenzaA__AEO01519
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguuccgccccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99108 - RNA, 1701 nt, Artificial Sequence; identical to SEQ ID NO: 97086
  derived and/or modified sequence opt2 from hemagglutinin__InfluenzaA__AEO01520

SEQ ID NO: 99109 - RNA, 1701 nt, Artificial Sequence; identical to SEQ ID NO: 95808
  derived and/or modified sequence opt2 from hemagglutinin__InfluenzaA__AEO01521

SEQ ID NO: 99110 - RNA, 1701 nt, Artificial Sequence; identical to SEQ ID NO: 97600
  derived and/or modified sequence opt2 from hemagglutinin__InfluenzaA__AEO01522

SEQ ID NO: 99111 - RNA, 1701 nt, Artificial Sequence; identical to SEQ ID NO: 95345
  derived and/or modified sequence opt2 from hemagglutinin__InfluenzaA__AEO01523

SEQ ID NO: 99112 - RNA, 1701 nt, Artificial Sequence; identical to SEQ ID NO: 98939
  derived and/or modified sequence opt2 from hemagglutinin__InfluenzaA__AEO01524

SEQ ID NO: 99113 - RNA, 1701 nt, Artificial Sequence
  derived and/or modified sequence opt2 from hemagglutinin__InfluenzaA__AEO01525
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuacccccgccucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99114 - RNA, 1701 nt, Artificial Sequence; identical to SEQ ID NO: 95345
  derived and/or modified sequence opt2 from hemagglutinin__InfluenzaA__AEO01526

SEQ ID NO: 99115 - RNA, 1701 nt, Artificial Sequence; identical to SEQ ID NO: 98122
  derived and/or modified sequence opt2 from hemagglutinin__InfluenzaA__AEO01527

SEQ ID NO: 99116 - RNA, 1701 nt, Artificial Sequence
  derived and/or modified sequence opt2 from hemagglutinin__InfluenzaA__AEO01529
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 99117 - RNA, 1701 nt, Artificial Sequence; identical to SEQ ID NO: 95345
  derived and/or modified sequence opt2 from hemagglutinin__InfluenzaA__AEO01530

SEQ ID NO: 99118 - RNA, 1701 nt, Artificial Sequence
  derived and/or modified sequence opt2 from hemagglutinin__InfluenzaA__AEO01531
augaaggccauccucgucguccuccucuacaccuucgccaccgccaacaccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 99119 - RNA, 1701 nt, Artificial Sequence; identical to SEQ ID NO: 98950
  derived and/or modified sequence opt2 from hemagglutinin__InfluenzaA__AEO01532

SEQ ID NO: 99120 - RNA, 1701 nt, Artificial Sequence
  derived and/or modified sequence opt2 from hemagglutinin__InfluenzaA__AEO01533
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99121 - RNA, 1701 nt, Artificial Sequence
  derived and/or modified sequence opt2 from hemagglutinin__InfluenzaA__AEO01534
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgcccgcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99122 - RNA, 1701 nt, Artificial Sequence; identical to SEQ ID NO: 95830
  derived and/or modified sequence opt2 from hemagglutinin__InfluenzaA__AEO01535

SEQ ID NO: 99123 - RNA, 1701 nt, Artificial Sequence; identical to SEQ ID NO: 95345
  derived and/or modified sequence opt2 from hemagglutinin__InfluenzaA__AEO01536

SEQ ID NO: 99124 - RNA, 1701 nt, Artificial Sequence; identical to SEQ ID NO: 97086
  derived and/or modified sequence opt2 from hemagglutinin__InfluenzaA__AEO01537

SEQ ID NO: 99125 - RNA, 1701 nt, Artificial Sequence
  derived and/or modified sequence opt2 from hemagglutinin__InfluenzaA__AEO01538
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99126 - RNA, 1701 nt, Artificial Sequence; identical to SEQ ID NO: 95808
  derived and/or modified sequence opt2 from hemagglutinin__InfluenzaA__AEO01539

SEQ ID NO: 99127 - RNA, 1701 nt, Artificial Sequence
  derived and/or modified sequence opt2 from hemagglutinin__InfluenzaA__AEO01540
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99128 - RNA, 1701 nt, Artificial Sequence; identical to SEQ ID NO: 95601
  derived and/or modified sequence opt2 from hemagglutinin__InfluenzaA__AEO01541

SEQ ID NO: 99129 - RNA, 1701 nt, Artificial Sequence; identical to SEQ ID NO: 95345
  derived and/or modified sequence opt2 from hemagglutinin__InfluenzaA__AEO01542

SEQ ID NO: 99130 - RNA, 1701 nt, Artificial Sequence; identical to SEQ ID NO: 95282
  derived and/or modified sequence opt2 from hemagglutinin__InfluenzaA__AEO01543

SEQ ID NO: 99131 - RNA, 1701 nt, Artificial Sequence; identical to SEQ ID NO: 95282
  derived and/or modified sequence opt2 from hemagglutinin__InfluenzaA__AEO01544

SEQ ID NO: 99132 - RNA, 1701 nt, Artificial Sequence
  derived and/or modified sequence opt2 from hemagglutinin__InfluenzaA__AEO01545
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacuccggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucgucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99133 - RNA, 1701 nt, Artificial Sequence; identical to SEQ ID NO: 94168
  derived and/or modified sequence opt2 from hemagglutinin__InfluenzaA__AEO01546

SEQ ID NO: 99134 - RNA, 1701 nt, Artificial Sequence; identical to SEQ ID NO: 94168
  derived and/or modified sequence opt2 from hemagglutinin__InfluenzaA__AEO01547

SEQ ID NO: 99135 - RNA, 1701 nt, Artificial Sequence; identical to SEQ ID NO: 94361
  derived and/or modified sequence opt2 from hemagglutinin__InfluenzaA__AEO01548

SEQ ID NO: 99136 - RNA, 1701 nt, Artificial Sequence; identical to SEQ ID NO: 94272
  derived and/or modified sequence opt2 from hemagglutinin__InfluenzaA__AEO01549

SEQ ID NO: 99137 - RNA, 1701 nt, Artificial Sequence; identical to SEQ ID NO: 94181
  derived and/or modified sequence opt2 from hemagglutinin__InfluenzaA__AEO01550

SEQ ID NO: 99138 - RNA, 1701 nt, Artificial Sequence; identical to SEQ ID NO: 94181
  derived and/or modified sequence opt2 from hemagglutinin__InfluenzaA__AEO01551

SEQ ID NO: 99139 - RNA, 1701 nt, Artificial Sequence; identical to SEQ ID NO: 94181
  derived and/or modified sequence opt2 from hemagglutinin__InfluenzaA__AEO01552

SEQ ID NO: 99140 - RNA, 1701 nt, Artificial Sequence; identical to SEQ ID NO: 94181
  derived and/or modified sequence opt2 from hemagglutinin__InfluenzaA__AEO01553

SEQ ID NO: 99141 - RNA, 1701 nt, Artificial Sequence; identical to SEQ ID NO: 94181
  derived and/or modified sequence opt2 from hemagglutinin__InfluenzaA__AEO01554

SEQ ID NO: 99142 - RNA, 1701 nt, Artificial Sequence; identical to SEQ ID NO: 94361
  derived and/or modified sequence opt2 from hemagglutinin__InfluenzaA__AEO01555

SEQ ID NO: 99143 - RNA, 1701 nt, Artificial Sequence; identical to SEQ ID NO: 94181
  derived and/or modified sequence opt2 from hemagglutinin__InfluenzaA__AEO01557

SEQ ID NO: 99144 - RNA, 1701 nt, Artificial Sequence; identical to SEQ ID NO: 94181
  derived and/or modified sequence opt2 from hemagglutinin__InfluenzaA__AEO01558

SEQ ID NO: 99145 - RNA, 1701 nt, Artificial Sequence
  derived and/or modified sequence opt2 from hemagglutinin__InfluenzaA__AEO01559
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccaggacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99146 - RNA, 1701 nt, Artificial Sequence; identical to SEQ ID NO: 94181
  derived and/or modified sequence opt2 from hemagglutinin__InfluenzaA__AEO01560

SEQ ID NO: 99147 - RNA, 1701 nt, Artificial Sequence; identical to SEQ ID NO: 94181
  derived and/or modified sequence opt2 from hemagglutinin__InfluenzaA__AEO01561

SEQ ID NO: 99148 - RNA, 1701 nt, Artificial Sequence; identical to SEQ ID NO: 94181
  derived and/or modified sequence opt2 from hemagglutinin__InfluenzaA__AEO01562

SEQ ID NO: 99149 - RNA, 1701 nt, Artificial Sequence; identical to SEQ ID NO: 94181
  derived and/or modified sequence opt2 from hemagglutinin__InfluenzaA__AEO01563

SEQ ID NO: 99150 - RNA, 1701 nt, Artificial Sequence; identical to SEQ ID NO: 94181
  derived and/or modified sequence opt2 from hemagglutinin__InfluenzaA__AEO01564

SEQ ID NO: 99151 - RNA, 1701 nt, Artificial Sequence; identical to SEQ ID NO: 94181
  derived and/or modified sequence opt2 from hemagglutinin__InfluenzaA__AEO01565

SEQ ID NO: 99152 - RNA, 1701 nt, Artificial Sequence; identical to SEQ ID NO: 94168
  derived and/or modified sequence opt2 from hemagglutinin__InfluenzaA__AEO01566

SEQ ID NO: 99153 - RNA, 1701 nt, Artificial Sequence; identical to SEQ ID NO: 94423
  derived and/or modified sequence opt2 from hemagglutinin__InfluenzaA__AEO01567

SEQ ID NO: 99154 - RNA, 1701 nt, Artificial Sequence; identical to SEQ ID NO: 94363
  derived and/or modified sequence opt2 from hemagglutinin__InfluenzaA__AEO01568

SEQ ID NO: 99155 - RNA, 1701 nt, Artificial Sequence; identical to SEQ ID NO: 94363
  derived and/or modified sequence opt2 from hemagglutinin__InfluenzaA__AEO01569

SEQ ID NO: 99156 - RNA, 1701 nt, Artificial Sequence; identical to SEQ ID NO: 94423
  derived and/or modified sequence opt2 from hemagglutinin__InfluenzaA__AEO01570

SEQ ID NO: 99157 - RNA, 1701 nt, Artificial Sequence; identical to SEQ ID NO: 94363
  derived and/or modified sequence opt2 from hemagglutinin__InfluenzaA__AEO01571

SEQ ID NO: 99158 - RNA, 1701 nt, Artificial Sequence; identical to SEQ ID NO: 94423
  derived and/or modified sequence opt2 from hemagglutinin__InfluenzaA__AEO01572

SEQ ID NO: 99159 - RNA, 1701 nt, Artificial Sequence; identical to SEQ ID NO: 94168
  derived and/or modified sequence opt2 from hemagglutinin__InfluenzaA__AEO01573

SEQ ID NO: 99160 - RNA, 1701 nt, Artificial Sequence; identical to SEQ ID NO: 94181
  derived and/or modified sequence opt2 from hemagglutinin__InfluenzaA__AEO01574

SEQ ID NO: 99161 - RNA, 1701 nt, Artificial Sequence; identical to SEQ ID NO: 94168
  derived and/or modified sequence opt2 from hemagglutinin__InfluenzaA__AEO01575

SEQ ID NO: 99162 - RNA, 1701 nt, Artificial Sequence; identical to SEQ ID NO: 94168
  derived and/or modified sequence opt2 from hemagglutinin__InfluenzaA__AEO01576

SEQ ID NO: 99163 - RNA, 1701 nt, Artificial Sequence; identical to SEQ ID NO: 94168
  derived and/or modified sequence opt2 from hemagglutinin__InfluenzaA__AEO01577

SEQ ID NO: 99164 - RNA, 1701 nt, Artificial Sequence; identical to SEQ ID NO: 94423
  derived and/or modified sequence opt2 from hemagglutinin__InfluenzaA__AEO01578

SEQ ID NO: 99165 - RNA, 1701 nt, Artificial Sequence; identical to SEQ ID NO: 94423
  derived and/or modified sequence opt2 from hemagglutinin__InfluenzaA__AEO01579

SEQ ID NO: 99166 - RNA, 1701 nt, Artificial Sequence; identical to SEQ ID NO: 94168
  derived and/or modified sequence opt2 from hemagglutinin__InfluenzaA__AEO01581

SEQ ID NO: 99167 - RNA, 1701 nt, Artificial Sequence; identical to SEQ ID NO: 94168
  derived and/or modified sequence opt2 from hemagglutinin__InfluenzaA__AEO01582

SEQ ID NO: 99168 - RNA, 1701 nt, Artificial Sequence; identical to SEQ ID NO: 94168
  derived and/or modified sequence opt2 from hemagglutinin__InfluenzaA__AEO01583

SEQ ID NO: 99169 - RNA, 1701 nt, Artificial Sequence; identical to SEQ ID NO: 94168
  derived and/or modified sequence opt2 from hemagglutinin__InfluenzaA__AEO01584

SEQ ID NO: 99170 - RNA, 1701 nt, Artificial Sequence; identical to SEQ ID NO: 94168
  derived and/or modified sequence opt2 from hemagglutinin__InfluenzaA__AEO01585

SEQ ID NO: 99171 - RNA, 1701 nt, Artificial Sequence; identical to SEQ ID NO: 94168
  derived and/or modified sequence opt2 from hemagglutinin__InfluenzaA__AEO01586

SEQ ID NO: 99172 - RNA, 1701 nt, Artificial Sequence; identical to SEQ ID NO: 94168
  derived and/or modified sequence opt2 from hemagglutinin__InfluenzaA__AEO01587

SEQ ID NO: 99173 - RNA, 1701 nt, Artificial Sequence; identical to SEQ ID NO: 94168
  derived and/or modified sequence opt2 from hemagglutinin__InfluenzaA__AEO01588

SEQ ID NO: 99174 - RNA, 1701 nt, Artificial Sequence; identical to SEQ ID NO: 94181
  derived and/or modified sequence opt2 from hemagglutinin__InfluenzaA__AEO01589

SEQ ID NO: 99175 - RNA, 1701 nt, Artificial Sequence; identical to SEQ ID NO: 94181
  derived and/or modified sequence opt2 from hemagglutinin__InfluenzaA__AEO01590

SEQ ID NO: 99176 - RNA, 1701 nt, Artificial Sequence; identical to SEQ ID NO: 94181
  derived and/or modified sequence opt2 from hemagglutinin__InfluenzaA__AEO01591

SEQ ID NO: 99177 - RNA, 1701 nt, Artificial Sequence; identical to SEQ ID NO: 94168
  derived and/or modified sequence opt2 from hemagglutinin__InfluenzaA__AEO01592

SEQ ID NO: 99178 - RNA, 1701 nt, Artificial Sequence; identical to SEQ ID NO: 94181
  derived and/or modified sequence opt2 from hemagglutinin__InfluenzaA__AEO01593

SEQ ID NO: 99179 - RNA, 1701 nt, Artificial Sequence; identical to SEQ ID NO: 94168
  derived and/or modified sequence opt2 from hemagglutinin__InfluenzaA__AEO01594

SEQ ID NO: 99180 - RNA, 1701 nt, Artificial Sequence; identical to SEQ ID NO: 94168
  derived and/or modified sequence opt2 from hemagglutinin__InfluenzaA__AEO01595

SEQ ID NO: 99181 - RNA, 1701 nt, Artificial Sequence; identical to SEQ ID NO: 94361
  derived and/or modified sequence opt2 from hemagglutinin__InfluenzaA__AEO01596

SEQ ID NO: 99182 - RNA, 1701 nt, Artificial Sequence; identical to SEQ ID NO: 94181
  derived and/or modified sequence opt2 from hemagglutinin__InfluenzaA__AEO01597

SEQ ID NO: 99183 - RNA, 1701 nt, Artificial Sequence
  derived and/or modified sequence opt2 from hemagglutinin__InfluenzaA__AEO01598
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaacggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99184 - RNA, 1701 nt, Artificial Sequence; identical to SEQ ID NO: 94181
  derived and/or modified sequence opt2 from hemagglutinin__InfluenzaA__AEO01599

SEQ ID NO: 99185 - RNA, 1701 nt, Artificial Sequence; identical to SEQ ID NO: 94181
  derived and/or modified sequence opt2 from hemagglutinin__InfluenzaA__AEO01600

SEQ ID NO: 99186 - RNA, 1701 nt, Artificial Sequence; identical to SEQ ID NO: 94181
  derived and/or modified sequence opt2 from hemagglutinin__InfluenzaA__AEO01601

SEQ ID NO: 99187 - RNA, 1701 nt, Artificial Sequence; identical to SEQ ID NO: 94181
  derived and/or modified sequence opt2 from hemagglutinin__InfluenzaA__AEO01602

SEQ ID NO: 99188 - RNA, 1701 nt, Artificial Sequence; identical to SEQ ID NO: 94181
  derived and/or modified sequence opt2 from hemagglutinin__InfluenzaA__AEO01603

SEQ ID NO: 99189 - RNA, 1701 nt, Artificial Sequence; identical to SEQ ID NO: 94181
  derived and/or modified sequence opt2 from hemagglutinin__InfluenzaA__AEO01604

SEQ ID NO: 99190 - RNA, 1701 nt, Artificial Sequence; identical to SEQ ID NO: 94181
  derived and/or modified sequence opt2 from hemagglutinin__InfluenzaA__AEO01605

SEQ ID NO: 99191 - RNA, 1701 nt, Artificial Sequence
  derived and/or modified sequence opt2 from hemagglutinin__InfluenzaA__AEO01606
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99192 - RNA, 1701 nt, Artificial Sequence; identical to SEQ ID NO: 94423
  derived and/or modified sequence opt2 from hemagglutinin__InfluenzaA__AEO01607

SEQ ID NO: 99193 - RNA, 1701 nt, Artificial Sequence; identical to SEQ ID NO: 97086
  derived and/or modified sequence opt2 from hemagglutinin__InfluenzaA__AEO01608

SEQ ID NO: 99194 - RNA, 1701 nt, Artificial Sequence; identical to SEQ ID NO: 98946
  derived and/or modified sequence opt2 from hemagglutinin__InfluenzaA__AEO01609

SEQ ID NO: 99195 - RNA, 1701 nt, Artificial Sequence
  derived and/or modified sequence opt2 from hemagglutinin__InfluenzaA__AEO01610
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcgucugcaucuga

SEQ ID NO: 99196 - RNA, 1701 nt, Artificial Sequence
  derived and/or modified sequence opt2 from hemagglutinin__InfluenzaA__AEO01611
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcgagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 99197 - RNA, 1701 nt, Artificial Sequence
  derived and/or modified sequence opt2 from hemagglutinin__InfluenzaA__AEO01612
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgccaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99198 - RNA, 1701 nt, Artificial Sequence; identical to SEQ ID NO: 96778
  derived and/or modified sequence opt2 from hemagglutinin__InfluenzaA__AEO01613

SEQ ID NO: 99199 - RNA, 1701 nt, Artificial Sequence
  derived and/or modified sequence opt2 from hemagglutinin__InfluenzaA__AEO01614
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99200 - RNA, 1701 nt, Artificial Sequence
  derived and/or modified sequence opt2 from hemagglutinin__InfluenzaA__AEO01615
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguacuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99201 - RNA, 1701 nt, Artificial Sequence; identical to SEQ ID NO: 94534
  derived and/or modified sequence opt2 from hemagglutinin__InfluenzaA__AEO01616

SEQ ID NO: 99202 - RNA, 1701 nt, Artificial Sequence; identical to SEQ ID NO: 95345
  derived and/or modified sequence opt2 from hemagglutinin__InfluenzaA__AEO01617

SEQ ID NO: 99203 - RNA, 1701 nt, Artificial Sequence; identical to SEQ ID NO: 95778
  derived and/or modified sequence opt2 from hemagglutinin__InfluenzaA__AEO01619

SEQ ID NO: 99204 - RNA, 1701 nt, Artificial Sequence; identical to SEQ ID NO: 98890
  derived and/or modified sequence opt2 from hemagglutinin__InfluenzaA__AEO01620

SEQ ID NO: 99205 - RNA, 1701 nt, Artificial Sequence; identical to SEQ ID NO: 99037
  derived and/or modified sequence opt2 from hemagglutinin__InfluenzaA__AEO01621

SEQ ID NO: 99206 - RNA, 1701 nt, Artificial Sequence
  derived and/or modified sequence opt2 from hemagglutinin__InfluenzaA__AEO01625
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgaggucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99207 - RNA, 1701 nt, Artificial Sequence
  derived and/or modified sequence opt2 from hemagglutinin__InfluenzaA__AEO01636
augaaguccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99208 - RNA, 1701 nt, Artificial Sequence
  derived and/or modified sequence opt2 from hemagglutinin__InfluenzaA__AEO01642
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaagugcaucacccccaacggcuccauccccaacgacaagcccuuccagaacgucaaccgcgucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99209 - RNA, 1698 nt, Artificial Sequence
  derived and/or modified sequence opt2 from hemagglutinin__InfluenzaA__AEO01663
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccuccgcgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccguccccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcguccgccucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99210 - RNA, 1698 nt, Artificial Sequence
  derived and/or modified sequence opt2 from hemagglutinin__InfluenzaA__AEO01674
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacgagaaccucaaggccccccgcuacgccuucgcccucucccgcggcuucggcuccggcaucaucaacuccaaggcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcguccgccucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99211 - RNA, 1701 nt, Artificial Sequence; identical to SEQ ID NO: 99206
  derived and/or modified sequence opt2 from hemagglutinin__InfluenzaA__AEO01691

SEQ ID NO: 99212 - RNA, 1698 nt, Artificial Sequence
  derived and/or modified sequence opt2 from hemagglutinin__InfluenzaA__AEO01699
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccccucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgccuaccagauccucgccaucuacuccaccggcgccuccucccucguccuccucgucucccucggcgccaucuccuucuggaugugcuccaacggcucccuccagcgccgcaucugcaucuga

SEQ ID NO: 99213 - RNA, 1698 nt, Artificial Sequence
  derived and/or modified sequence opt2 from hemagglutinin__InfluenzaA__AEO01709
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagcuccgcgaccaggacggccgcaucaacuacuacuggacccuccucgagcccggcgacaccaccaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgagcucuaccucaagugcaacggcgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99214 - RNA, 1701 nt, Artificial Sequence; identical to SEQ ID NO: 95345
  derived and/or modified sequence opt2 from hemagglutinin__InfluenzaA__AEO37530

SEQ ID NO: 99215 - RNA, 1701 nt, Artificial Sequence
  derived and/or modified sequence opt2 from hemagglutinin__InfluenzaA__AEO72176
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgccgucucccucggcgccaucuccuucuggaugugcuccaacggcucccuccagugccgcaucugcaucuga

SEQ ID NO: 99216 - RNA, 1704 nt, Artificial Sequence
  derived and/or modified sequence opt2 from hemagglutinin__InfluenzaA__AEO88980
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99217 - RNA, 1704 nt, Artificial Sequence
  derived and/or modified sequence opt2 from hemagglutinin__InfluenzaA__AEO89021
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccccaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacaacgccgccgagcagaccaagcucuaccagaaccccaccaccuacaucuccgucggcaccuccacccucaaccuccgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99218 - RNA, 1704 nt, Artificial Sequence
  derived and/or modified sequence opt2 from hemagglutinin__InfluenzaA__AEO89030
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgucugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccguccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99219 - RNA, 1704 nt, Artificial Sequence
  derived and/or modified sequence opt2 from hemagglutinin__InfluenzaA__AEO89048
auggagaagaucgucuuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucaucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccauccucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99220 - RNA, 1704 nt, Artificial Sequence
  derived and/or modified sequence opt2 from hemagglutinin__InfluenzaA__AEO89065
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgucugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccuccgccucguccccaagaucgccacccgcuccaaggucaacggccaguccggccgcauggacuucuucuggaccauccucaagcccuccgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99221 - RNA, 1704 nt, Artificial Sequence
  derived and/or modified sequence opt2 from hemagglutinin__InfluenzaA__AEO89082
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgacaccuccuccggcgucuccuccgccugccccuaccagggcacccccuccuucuuccgcaacgucgucuggcucaucaagaagaacaacaccuaccccaccaucaagcgcuccuacaacaacaccaacaaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99222 - RNA, 1704 nt, Artificial Sequence
  derived and/or modified sequence opt2 from hemagglutinin__InfluenzaA__AEO89091
auggagaagaccgucuuccuccucgccaucgucucccucgucaaguccgaccagaucugcaucggcuaccacgccaacaacuccaccgagcaggucgacaccaucauggagaagaacgucaccgucacccacgcccagaacauccucgagaagacccacaacggcaagcucugcgacaucgacggcgucaagccccucauccucaaggacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccaccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgaggccgagcaggccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacgacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcaucuga

SEQ ID NO: 99223 - RNA, 1704 nt, Artificial Sequence
  derived and/or modified sequence opt2 from hemagglutinin__InfluenzaA__AEO89100
auggagaagaucguccccuuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaagaacuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuuccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacgacgagugcauggaguccgucaagaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99224 - RNA, 1704 nt, Artificial Sequence
  derived and/or modified sequence opt2 from hemagglutinin__InfluenzaA__AEO89109
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccgccgagcagaucaagcucuaccagaaccccaccaccuacaucuccgucggcaccuccacccucaaccagcgccucgucaccaagaucgccacccgccccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99225 - RNA, 1704 nt, Artificial Sequence
  derived and/or modified sequence opt2 from hemagglutinin__InfluenzaA__AEO89127
auggagaagaucguccuccuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccgccgagcagaucaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgccgccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcaucaagcucgaguccaugggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99226 - RNA, 1704 nt, Artificial Sequence
  derived and/or modified sequence opt2 from hemagglutinin__InfluenzaA__AEO89145
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucggcgacugcuccgucgccggcuggcuccucggcaaccccaugugcgacaaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaccaagaagaacaacaccuaccccaccaucaagcgcuccuacaacaacaccaaccaggaggaccuccucauccucuggggcauccaccacuccaacaacgccgccgagcaggagaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccggcgucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgccgccuccucccucgcccucgccaucauggucgccggccucucccucuggaugugcuccaacggcucccuccagugccgcaucugcaucuga

SEQ ID NO: 99227 - RNA, 1707 nt, Artificial Sequence
  derived and/or modified sequence opt2 from hemagglutinin__InfluenzaA__AEO89163
auggagaagaucguccuccucuucgccaucgucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucgacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccuggcccgaccacgaggccucccucggcgucuccuccgccugccccuaccagggcaacuccuccuucuuccgcaacgucgucuggcucaucaagaagggcaacgccuaccccaccaucaagaaguccuacaacaacaccaacaaggaggaccuccucauccucuggggcauccaccaccccaacgacgaggccgagcagacccgccucuaccagaaccccaccaccuacaucuccaucggcaccuccacccucaaccagcgccucgucccccgcaucgccacccgcuccaaggucaacggccaguccggccgcaucgacuucuucuggaccauccucaagcccaacgacgccaucaacuucgaguccaacggcaacuucaucgcccccgaguacgccuacaagaucgucaagaagggcgacuccaccaucaugaaguccgaggucgaguacggcaacugcaacacccgcugccagacccccaugggcgccaucaacuccuccaugcccuuccacaacauccacccccucaccaucggcgagugccccaaguacgucaaguccaacaagcucguccucgccaccggccuccgcaacuccccccagcgcgagcgccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucguccucgccaucauggucgccggccucucccucuggaugugcuccaacggcucccuccagugccgcaucugcaucuga

SEQ ID NO: 99228 - RNA, 1704 nt, Artificial Sequence
  derived and/or modified sequence opt2 from hemagglutinin__InfluenzaA__AEO89172
auggagaagaucguccuccuccucgccaucgucucccucguccgcuccgaccagaucugcaucggcuaccacgccaacaacuccaccgagcaggucgacaccaucauggagaagaacgucaccgucacccacgcccagaacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucguccucuggggcauccaccacuccaacgacgccaccgagcagaucaagcucuaccagaaccccaccaccuacgucuccgucggcaccuccacccucaaccagcgccucguccccaagaucgccacccgcuccaaggucaacggccaguccggccgcauggacuucuucuggaccauccucaaguccaacgacgccaucaacuucgaguccaacggcaacuucaucgcccccgaguacgccuacaagaucgucaagaagggcgacuccgccaucaugaaguccgaggucgaguacggcaacugcuccaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99229 - RNA, 1704 nt, Artificial Sequence
  derived and/or modified sequence opt2 from hemagglutinin__InfluenzaA__AEO89181
auggagaagaucguccuccucuucgccaccaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaagaacuccugguccgaccacgaggccucccucggcgucuccgccgccugccccuaccagggcaaguccuccuucuuccgcaacgucgucuggcucaucaagaaggacaacgccuaccccaccaucaagaagggcuacaacaacaccaaccaggaggaccuccucguccucuggggcauccaccaccccaacgacgaggccgagcagacccgccucuaccagaaccccaccaccuacaucuccaucggcaccuccacccucaaccagcgccucguccccaagaucgccacccgcuccaagaucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugaaguccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacguccgcaaccucuacgacaagguccgccuccagcucaaggacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 99230 - RNA, 1704 nt, Artificial Sequence
  derived and/or modified sequence opt2 from hemagglutinin__InfluenzaA__AEO89192
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccgccgagcagaucaagcucuaccagaaccccaccaccuacgucuccaucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuacccccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucaacggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99231 - RNA, 1704 nt, Artificial Sequence
  derived and/or modified sequence opt2 from hemagglutinin__InfluenzaA__AEO89203
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccgccgagcagaucaagcucuaccagaaccccaccaccuacgucuccaucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucaacggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99232 - RNA, 1704 nt, Artificial Sequence; identical to SEQ ID NO: 99231
  derived and/or modified sequence opt2 from hemagglutinin__InfluenzaA__AEO89213

SEQ ID NO: 99233 - RNA, 1704 nt, Artificial Sequence; identical to SEQ ID NO: 99231
  derived and/or modified sequence opt2 from hemagglutinin__InfluenzaA__AEO89224

SEQ ID NO: 99234 - RNA, 1704 nt, Artificial Sequence
  derived and/or modified sequence opt2 from hemagglutinin__InfluenzaA__AEO89235
auggagaagaucguccuccuccucgccauggucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaaccucaacgacuacgaggagcucaagcaccuccucucccgcaucaaccacuucgagaagauccagaucauccccaaguccuccugguccgaccacgaggccucccucggcgucuccuccgccugccccuaccagggcacccccuccuucuuccgcaacgucaucuggcucaucaagaagaacaacaccuaccccaccaucaagcgcuccuacaacaacaccaaccaggaggaccuccucauccucuggggcauccaccacuccaacgacgaggccgagcagaucaagcucuaccagaaccccaccaccuacaucuccgucggcaccuccacccucaaccagcgccucguccccaagaucgccacccgcuccaaggucaacggccaguccggccgcauggacuucuucuggaccauccucaagcccgacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagaagcgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99235 - RNA, 1704 nt, Artificial Sequence
  derived and/or modified sequence opt2 from hemagglutinin__InfluenzaA__AEO89246
auggagaagaucgucccccuccucgccauggucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaaccucaacgacuacgaggagcucaagcaccuccucucccgcaucaaccacuucgagaagauccagaucauccccaaguccuccugguccgaccacgaggccucccucggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgaggccgagcagaucaagcucuaccagaaccccaccaccuacaucuccgucggcaccuccacccucaaccagcgccucguccccaagaucgccacccgcuccaaggucaacggccaguccggccgcauggacuucuucuggaccauccucaagcccgacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucuccaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 99236 - RNA, 1704 nt, Artificial Sequence
  derived and/or modified sequence opt2 from hemagglutinin__InfluenzaA__AEO89257
auggagaagaucguccuccuccucgccaucgucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucguccucuggggcauccaccacuccaacgacgccgccgagcagaucaagcucuaccagaaccccaccaccuacgucuccgucggcaccuccacccucaaccagcgccucguccccaagaucgccacccgcuccaaggucaacggccaguccggccgcauggacuucuucuggaccauccucaaguccaacgacgccaucaacuucgaguccaacggcaacuucaucgcccccgaguacgccuacaagaucgucaagaagggcgacuccgccaucaugaaguccgaggucgaguacggcaacugcuccaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucguccucgccaucauggucgccggccucucccucuggaugugcuccaacggcucccuccagugccgcaucugcaucuga

SEQ ID NO: 99237 - RNA, 1704 nt, Artificial Sequence; identical to SEQ ID NO: 99236
  derived and/or modified sequence opt2 from hemagglutinin__InfluenzaA__AEO89268

SEQ ID NO: 99238 - RNA, 1704 nt, Artificial Sequence
  derived and/or modified sequence opt2 from hemagglutinin__InfluenzaA__AEO89279
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucggcgacugcuccgucgccggcuggcuccucggcaaccccaugugcgacaaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacaacgccgccgagcaggagaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccggcgucaaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgccgccuccucccucgcccucgccaucauggucgccggccucucccucuggaugugcuccaacggcucccuccagugccgcaucugcaucuga

SEQ ID NO: 99239 - RNA, 1704 nt, Artificial Sequence
  derived and/or modified sequence opt2 from hemagglutinin__InfluenzaA__AEO89289
auggagaagaucguccuccuccucgccaucgucucccucgccaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucggcgacugcuccgucgccggcuggcuccucggcaaccccaugugcgacaaguucaucaacguccccgagugguccuacaucgucgagaaggucaaccccgccaacgaccucugcuaccccggcaacuucaacgacuacgaggagcucaagcaccuccucucccgcaucaaccacuucgagaagaucaagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacaacgucgccgagcaggagaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacaccaucaacuucgaguccaacggcaacuucaucgcccccgaguacgccuacaagaucgucaagaagggcgacuccgccaucaugaaguccggcgucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccgcuacuccgaggaggcccgccucaagcgcgaggagaucuccggcgucaagcucgaguccaucggcaccuaccagauccucuccaucuacuccaccgccgccuccucccucgcccucgccaucauggucgccggccucucccucuggaugugcuccaacggcucccuccagugccgcaucugcaucuga

SEQ ID NO: 99240 - RNA, 1704 nt, Artificial Sequence
  derived and/or modified sequence opt2 from hemagglutinin__InfluenzaA__AEO89300
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccgccgagcagaucaagcucuaccagcaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucaacggcgucaagcucgaguccaugggcaccuaccagauccucuccaucuacuccaccgucgccuccucccucgcccucgccaucauggucgccggccucuccuucuggaugugcuccaacggcucccuccagugccgcaucugcaucuga

SEQ ID NO: 99241 - RNA, 1704 nt, Artificial Sequence
  derived and/or modified sequence opt2 from hemagglutinin__InfluenzaA__AEO89311
auggagaagaucguccuccucuucgccaucgucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccugguccgaccacgaggccucccucggcgucuccgccgccugccccuaccagggcaacuccuccuucuuccgcaacgucgucuggcucaucaagaaggacaacgccuaccccaccaucaagaaguccuacaacaacaccaaccaggaggaccuccucauccucuggggcauccaccaccccaacgacgaggccgagcagacccgccucuaccagaaccccaccaccuacaucuccaucggcaccuccacccucaaccagcgccucguccccaagaucgccacccgcuccaaggucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugaaguccgaggucgaguacggcaacugcaacacccgcugccagacccccaugggcgccaucaacuccuccaugcccuuccacaacauccacccccucaccaucggcgagugccccaaguacgucaaguccaccaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaagcucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcaacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 99242 - RNA, 1701 nt, Artificial Sequence; identical to SEQ ID NO: 93440
  derived and/or modified sequence opt2 from hemagglutinin__InfluenzaA__AEO99215

SEQ ID NO: 99243 - RNA, 1698 nt, Artificial Sequence
  derived and/or modified sequence opt2 from hemagglutinin__InfluenzaA__AEQ38187
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99244 - RNA, 1698 nt, Artificial Sequence; identical to SEQ ID NO: 99243
  derived and/or modified sequence opt2 from hemagglutinin__InfluenzaA__AEQ38188

SEQ ID NO: 99245 - RNA, 1698 nt, Artificial Sequence
  derived and/or modified sequence opt2 from hemagglutinin__InfluenzaA__AEQ38189
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99246 - RNA, 1698 nt, Artificial Sequence
  derived and/or modified sequence opt2 from hemagglutinin__InfluenzaA__AEQ38190
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaagcccuacgccaacaacaaggagaaggagguccucguccucuggggcguccaccacccccccaacaucgccguccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99247 - RNA, 1698 nt, Artificial Sequence; identical to SEQ ID NO: 95138
  derived and/or modified sequence opt2 from hemagglutinin__InfluenzaA__AEQ38191

SEQ ID NO: 99248 - RNA, 1698 nt, Artificial Sequence
  derived and/or modified sequence opt2 from hemagglutinin__InfluenzaA__AEQ38192
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucaccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacacccccauggacaagugcgacaccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99249 - RNA, 1698 nt, Artificial Sequence
  derived and/or modified sequence opt2 from hemagglutinin__InfluenzaA__AEQ38193
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99250 - RNA, 1698 nt, Artificial Sequence
  derived and/or modified sequence opt2 from hemagglutinin__InfluenzaA__AEQ38194
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccgcaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagcgcgucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99251 - RNA, 1698 nt, Artificial Sequence
  derived and/or modified sequence opt2 from hemagglutinin__InfluenzaA__AEQ38195
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccaugggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99252 - RNA, 1698 nt, Artificial Sequence
  derived and/or modified sequence opt2 from hemagglutinin__InfluenzaA__AEQ38196
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgccuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgaguaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99253 - RNA, 1698 nt, Artificial Sequence; identical to SEQ ID NO: 99243
  derived and/or modified sequence opt2 from hemagglutinin__InfluenzaA__AEQ38197

SEQ ID NO: 99254 - RNA, 1698 nt, Artificial Sequence; identical to SEQ ID NO: 99243
  derived and/or modified sequence opt2 from hemagglutinin__InfluenzaA__AEQ38198

SEQ ID NO: 99255 - RNA, 1701 nt, Artificial Sequence; identical to SEQ ID NO: 98562
  derived and/or modified sequence opt2 from hemagglutinin__InfluenzaA__AEQ62909

SEQ ID NO: 99256 - RNA, 1701 nt, Artificial Sequence
  derived and/or modified sequence opt2 from hemagglutinin__InfluenzaA__AEQ62910
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccgccucccccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucauguggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagucccccaagggcgccaucaacaccucccuccccuuccagaacauccaccccaucaccaucggcgagugccccaaguacgucaaguccaccaagcuccgccucgccaccggccuccgcaacguccccuccguccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccagcucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99257 - RNA, 1701 nt, Artificial Sequence; identical to SEQ ID NO: 98379
  derived and/or modified sequence opt2 from hemagglutinin__InfluenzaA__AEQ62911

SEQ ID NO: 99258 - RNA, 1701 nt, Artificial Sequence; identical to SEQ ID NO: 98562
  derived and/or modified sequence opt2 from hemagglutinin__InfluenzaA__AEQ62912

SEQ ID NO: 99259 - RNA, 1701 nt, Artificial Sequence
  derived and/or modified sequence opt2 from hemagglutinin__InfluenzaA__AEQ62915
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99260 - RNA, 1701 nt, Artificial Sequence; identical to SEQ ID NO: 94923
  derived and/or modified sequence opt2 from hemagglutinin__InfluenzaA__AER08646

SEQ ID NO: 99261 - RNA, 1701 nt, Artificial Sequence; identical to SEQ ID NO: 96931
  derived and/or modified sequence opt2 from hemagglutinin__InfluenzaA__AER08648

SEQ ID NO: 99262 - RNA, 1701 nt, Artificial Sequence
  derived and/or modified sequence opt2 from hemagglutinin__InfluenzaA__AER08652
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccuccgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99263 - RNA, 1701 nt, Artificial Sequence; identical to SEQ ID NO: 99262
  derived and/or modified sequence opt2 from hemagglutinin__InfluenzaA__AER08654

SEQ ID NO: 99264 - RNA, 1701 nt, Artificial Sequence
  derived and/or modified sequence opt2 from hemagglutinin__InfluenzaA__AER08656
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagaugcaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99265 - RNA, 1701 nt, Artificial Sequence
  derived and/or modified sequence opt2 from hemagglutinin__InfluenzaA__AER08660
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99266 - RNA, 1701 nt, Artificial Sequence
  derived and/or modified sequence opt2 from hemagglutinin__InfluenzaA__AER08664
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacuccgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99267 - RNA, 1701 nt, Artificial Sequence; identical to SEQ ID NO: 98494
  derived and/or modified sequence opt2 from hemagglutinin__InfluenzaA__AER08668

SEQ ID NO: 99268 - RNA, 1701 nt, Artificial Sequence
  derived and/or modified sequence opt2 from hemagglutinin__InfluenzaA__AER08670
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99269 - RNA, 1701 nt, Artificial Sequence
  derived and/or modified sequence opt2 from hemagglutinin__InfluenzaA__AER08672
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcggcaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacuccgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99270 - RNA, 1701 nt, Artificial Sequence
  derived and/or modified sequence opt2 from hemagglutinin__InfluenzaA__AER08674
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99271 - RNA, 1701 nt, Artificial Sequence; identical to SEQ ID NO: 98494
  derived and/or modified sequence opt2 from hemagglutinin__InfluenzaA__AER08676

SEQ ID NO: 99272 - RNA, 1701 nt, Artificial Sequence; identical to SEQ ID NO: 98494
  derived and/or modified sequence opt2 from hemagglutinin__InfluenzaA__AER08678

SEQ ID NO: 99273 - RNA, 1701 nt, Artificial Sequence
  derived and/or modified sequence opt2 from hemagglutinin__InfluenzaA__AER08680
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99274 - RNA, 1701 nt, Artificial Sequence
  derived and/or modified sequence opt2 from hemagglutinin__InfluenzaA__AER08682
augaagaccgucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99275 - RNA, 1701 nt, Artificial Sequence
  derived and/or modified sequence opt2 from hemagglutinin__InfluenzaA__AER08684
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99276 - RNA, 1701 nt, Artificial Sequence
  derived and/or modified sequence opt2 from hemagglutinin__InfluenzaA__AER08686
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacaucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99277 - RNA, 1701 nt, Artificial Sequence; identical to SEQ ID NO: 98494
  derived and/or modified sequence opt2 from hemagglutinin__InfluenzaA__AER08688

SEQ ID NO: 99278 - RNA, 1701 nt, Artificial Sequence
  derived and/or modified sequence opt2 from hemagglutinin__InfluenzaA__AER08690
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99279 - RNA, 1701 nt, Artificial Sequence; identical to SEQ ID NO: 98494
  derived and/or modified sequence opt2 from hemagglutinin__InfluenzaA__AER08692

SEQ ID NO: 99280 - RNA, 1701 nt, Artificial Sequence
  derived and/or modified sequence opt2 from hemagglutinin__InfluenzaA__AER08698
augaagaccaccaucgcccucucccacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99281 - RNA, 1701 nt, Artificial Sequence; identical to SEQ ID NO: 98494
  derived and/or modified sequence opt2 from hemagglutinin__InfluenzaA__AER08700

SEQ ID NO: 99282 - RNA, 1701 nt, Artificial Sequence
  derived and/or modified sequence opt2 from hemagglutinin__InfluenzaA__AER92712
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucaccaucgagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99283 - RNA, 1701 nt, Artificial Sequence; identical to SEQ ID NO: 97045
  derived and/or modified sequence opt2 from hemagglutinin__InfluenzaA__AET10090

SEQ ID NO: 99284 - RNA, 1701 nt, Artificial Sequence; identical to SEQ ID NO: 97045
  derived and/or modified sequence opt2 from hemagglutinin__InfluenzaA__AET10091

SEQ ID NO: 99285 - RNA, 1701 nt, Artificial Sequence; identical to SEQ ID NO: 97045
  derived and/or modified sequence opt2 from hemagglutinin__InfluenzaA__AET10092

SEQ ID NO: 99286 - RNA, 1701 nt, Artificial Sequence
  derived and/or modified sequence opt2 from hemagglutinin__InfluenzaA__AET10094
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99287 - RNA, 1701 nt, Artificial Sequence
  derived and/or modified sequence opt2 from hemagglutinin__InfluenzaA__AET10095
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99288 - RNA, 1701 nt, Artificial Sequence
  derived and/or modified sequence opt2 from hemagglutinin__InfluenzaA__AET10096
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaaguggaaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99289 - RNA, 1701 nt, Artificial Sequence
  derived and/or modified sequence opt2 from hemagglutinin__InfluenzaA__AET10098
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99290 - RNA, 1701 nt, Artificial Sequence; identical to SEQ ID NO: 98367
  derived and/or modified sequence opt2 from hemagglutinin__InfluenzaA__AET10099

SEQ ID NO: 99291 - RNA, 1701 nt, Artificial Sequence; identical to SEQ ID NO: 98494
  derived and/or modified sequence opt2 from hemagglutinin__InfluenzaA__AET10100

SEQ ID NO: 99292 - RNA, 1701 nt, Artificial Sequence
  derived and/or modified sequence opt2 from hemagglutinin__InfluenzaA__AET10101
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcgccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99293 - RNA, 1701 nt, Artificial Sequence
  derived and/or modified sequence opt2 from hemagglutinin__InfluenzaA__AET10102
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuucgacguccccgacuacgccucccuccgcucccucgucgccuccuccggcacccucgaguucaacaacgaguccuucaacuggaccggcgucacccagaacggcaccuccuccgccugcaugcgccgcuccaaguccuccuucuucucccgccucaacuggcucacccaccucaacuucaaguaccccgcccucaacgucaccaugcccaacgacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggccgcaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgccucccucggcuucaucaugugggccugccagaagggcaacauccgcugcaacaucugcaucuga

SEQ ID NO: 99294 - RNA, 1701 nt, Artificial Sequence
  derived and/or modified sequence opt2 from hemagglutinin__InfluenzaA__AET10103
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99295 - RNA, 1701 nt, Artificial Sequence
  derived and/or modified sequence opt2 from hemagglutinin__InfluenzaA__AET10104
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucggcaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99296 - RNA, 1701 nt, Artificial Sequence
  derived and/or modified sequence opt2 from hemagglutinin__InfluenzaA__AET10105
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99297 - RNA, 1701 nt, Artificial Sequence
  derived and/or modified sequence opt2 from hemagglutinin__InfluenzaA__AET10106
augaagaccaucaucgcccucuccuacauccucugccucgucuucgcccagaagcuccccggcaacuacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99298 - RNA, 1701 nt, Artificial Sequence
  derived and/or modified sequence opt2 from hemagglutinin__InfluenzaA__AET10107
augaagaccaucaucgcccucuccuacauccucugccucgucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 99299 - RNA, 1701 nt, Artificial Sequence; identical to SEQ ID NO: 94923
  derived and/or modified sequence opt2 from hemagglutinin__InfluenzaA__AET10108

SEQ ID NO: 99300 - RNA, 1701 nt, Artificial Sequence; identical to SEQ ID NO: 98494
  derived and/or modified sequence opt2 from hemagglutinin__InfluenzaA__AET10109

SEQ ID NO: 99301 - RNA, 1701 nt, Artificial Sequence
  derived and/or modified sequence opt2 from hemagglutinin__InfluenzaA__AET10110
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 99302 - RNA, 1701 nt, Artificial Sequence
  derived and/or modified sequence opt2 from hemagglutinin__InfluenzaA__AET10111
augaagaccaucaucgcccucuccuacauccucugccucgucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucuccaacuccaccggcaaccucaucggcccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99303 - RNA, 1701 nt, Artificial Sequence
  derived and/or modified sequence opt2 from hemagglutinin__InfluenzaA__AET10113
augaagaccaucaucgcccucuccuacauccucugccucgucuucgcccaggagcuccccggcaacgacaacuccaccgccacccucugccucggccaccacgccguccagaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99304 - RNA, 1701 nt, Artificial Sequence
  derived and/or modified sequence opt2 from hemagglutinin__InfluenzaA__AET10114
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaugugcaacaucugcaucuga

SEQ ID NO: 99305 - RNA, 1698 nt, Artificial Sequence
  derived and/or modified sequence opt2 from hemagglutinin__InfluenzaA__AET50439
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99306 - RNA, 1698 nt, Artificial Sequence
  derived and/or modified sequence opt2 from hemagglutinin__InfluenzaA__AET50440
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccacccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99307 - RNA, 1698 nt, Artificial Sequence
  derived and/or modified sequence opt2 from hemagglutinin__InfluenzaA__AET50441
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccacccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcggccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99308 - RNA, 1698 nt, Artificial Sequence
  derived and/or modified sequence opt2 from hemagglutinin__InfluenzaA__AET50442
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaucugcuaccccggccacuucgccgacuacgaggagcuccgcgagcagcucuccuccgucuccuccuucgagcgcuucgagaucuuccccaaggaguccuccuggcccacccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcggccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99309 - RNA, 1698 nt, Artificial Sequence
  derived and/or modified sequence opt2 from hemagglutinin__InfluenzaA__AET84163
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagucccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccaaccagaagacccucuaccacaccgagaacgccuacgucuccgucgucuccucccacuacucccgcaaguucacccccgaggucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99310 - RNA, 1698 nt, Artificial Sequence
  derived and/or modified sequence opt2 from hemagglutinin__InfluenzaA__AET84174
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucauccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99311 - RNA, 1698 nt, Artificial Sequence
  derived and/or modified sequence opt2 from hemagglutinin__InfluenzaA__AET84196
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagucccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucacccgcaagaacggccucuaccccacccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccuccgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacaacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99312 - RNA, 1698 nt, Artificial Sequence
  derived and/or modified sequence opt2 from hemagglutinin__InfluenzaA__AET84207
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccguccccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99313 - RNA, 1698 nt, Artificial Sequence
  derived and/or modified sequence opt2 from hemagglutinin__InfluenzaA__AET84218
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucuccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99314 - RNA, 1698 nt, Artificial Sequence
  derived and/or modified sequence opt2 from hemagglutinin__InfluenzaA__AET84229
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccacccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacaucccccccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99315 - RNA, 1698 nt, Artificial Sequence
  derived and/or modified sequence opt2 from hemagglutinin__InfluenzaA__AET84240
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99316 - RNA, 1698 nt, Artificial Sequence
  derived and/or modified sequence opt2 from hemagglutinin__InfluenzaA__AET84251
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucaaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccacggcgccaucaacuccugccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaacaaggagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99317 - RNA, 1698 nt, Artificial Sequence
  derived and/or modified sequence opt2 from hemagglutinin__InfluenzaA__AET84262
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccacggcgccaucaacuccugccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99318 - RNA, 1698 nt, Artificial Sequence; identical to SEQ ID NO: 99245
  derived and/or modified sequence opt2 from hemagglutinin__InfluenzaA__AET84284

SEQ ID NO: 99319 - RNA, 1698 nt, Artificial Sequence
  derived and/or modified sequence opt2 from hemagglutinin__InfluenzaA__AET84306
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacuccaucaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99320 - RNA, 1698 nt, Artificial Sequence
  derived and/or modified sequence opt2 from hemagglutinin__InfluenzaA__AET84339
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccaacaucggcaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99321 - RNA, 1698 nt, Artificial Sequence; identical to SEQ ID NO: 99320
  derived and/or modified sequence opt2 from hemagglutinin__InfluenzaA__AET84361

SEQ ID NO: 99322 - RNA, 1698 nt, Artificial Sequence
  derived and/or modified sequence opt2 from hemagglutinin__InfluenzaA__AET84372
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99323 - RNA, 1698 nt, Artificial Sequence
  derived and/or modified sequence opt2 from hemagglutinin__InfluenzaA__AET84394
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccgacaucggcaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgagaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99324 - RNA, 1698 nt, Artificial Sequence; identical to SEQ ID NO: 97028
  derived and/or modified sequence opt2 from hemagglutinin__InfluenzaA__AET84405

SEQ ID NO: 99325 - RNA, 1698 nt, Artificial Sequence
  derived and/or modified sequence opt2 from hemagglutinin__InfluenzaA__AET84416
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccacccucuccaaguccuacgccaacaacaaggagaaggagguccucguccucuggggcguccaccacccccccgacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99326 - RNA, 1698 nt, Artificial Sequence
  derived and/or modified sequence opt2 from hemagglutinin__InfluenzaA__AET84427
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99327 - RNA, 1698 nt, Artificial Sequence
  derived and/or modified sequence opt2 from hemagglutinin__InfluenzaA__AET84438
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaagacccucuacaacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucauguucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99328 - RNA, 1698 nt, Artificial Sequence
  derived and/or modified sequence opt2 from hemagglutinin__InfluenzaA__AET84449
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacggcugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99329 - RNA, 1701 nt, Artificial Sequence
  derived and/or modified sequence opt2 from hemagglutinin__InfluenzaA__AET98600
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccguccccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99330 - RNA, 1701 nt, Artificial Sequence
  derived and/or modified sequence opt2 from hemagglutinin__InfluenzaA__AEV76874
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaaccccgagaucgagauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99331 - RNA, 1701 nt, Artificial Sequence; identical to SEQ ID NO: 94181
  derived and/or modified sequence opt2 from hemagglutinin__InfluenzaA__AEW10574

SEQ ID NO: 99332 - RNA, 1701 nt, Artificial Sequence; identical to SEQ ID NO: 94181
  derived and/or modified sequence opt2 from hemagglutinin__InfluenzaA__AEW10584

SEQ ID NO: 99333 - RNA, 1701 nt, Artificial Sequence; identical to SEQ ID NO: 94534
  derived and/or modified sequence opt2 from hemagglutinin__InfluenzaA__AEW10594

SEQ ID NO: 99334 - RNA, 1701 nt, Artificial Sequence; identical to SEQ ID NO: 94534
  derived and/or modified sequence opt2 from hemagglutinin__InfluenzaA__AEW10604

SEQ ID NO: 99335 - RNA, 1701 nt, Artificial Sequence; identical to SEQ ID NO: 94534
  derived and/or modified sequence opt2 from hemagglutinin__InfluenzaA__AEW10614

SEQ ID NO: 99336 - RNA, 1701 nt, Artificial Sequence; identical to SEQ ID NO: 94534
  derived and/or modified sequence opt2 from hemagglutinin__InfluenzaA__AEW10624

SEQ ID NO: 99337 - RNA, 1701 nt, Artificial Sequence; identical to SEQ ID NO: 94181
  derived and/or modified sequence opt2 from hemagglutinin__InfluenzaA__AEW10634

SEQ ID NO: 99338 - RNA, 1701 nt, Artificial Sequence; identical to SEQ ID NO: 94168
  derived and/or modified sequence opt2 from hemagglutinin__InfluenzaA__AEW10644

SEQ ID NO: 99339 - RNA, 1701 nt, Artificial Sequence
  derived and/or modified sequence opt2 from hemagglutinin__InfluenzaA__AEW10654
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99340 - RNA, 1701 nt, Artificial Sequence; identical to SEQ ID NO: 94168
  derived and/or modified sequence opt2 from hemagglutinin__InfluenzaA__AEW10664

SEQ ID NO: 99341 - RNA, 1701 nt, Artificial Sequence
  derived and/or modified sequence opt2 from hemagglutinin__InfluenzaA__AEW10674
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99342 - RNA, 1701 nt, Artificial Sequence; identical to SEQ ID NO: 94181
  derived and/or modified sequence opt2 from hemagglutinin__InfluenzaA__AEW10684

SEQ ID NO: 99343 - RNA, 1701 nt, Artificial Sequence; identical to SEQ ID NO: 94168
  derived and/or modified sequence opt2 from hemagglutinin__InfluenzaA__AEW10694

SEQ ID NO: 99344 - RNA, 1701 nt, Artificial Sequence; identical to SEQ ID NO: 94168
  derived and/or modified sequence opt2 from hemagglutinin__InfluenzaA__AEW10704

SEQ ID NO: 99345 - RNA, 1701 nt, Artificial Sequence; identical to SEQ ID NO: 99339
  derived and/or modified sequence opt2 from hemagglutinin__InfluenzaA__AEW10724

SEQ ID NO: 99346 - RNA, 1701 nt, Artificial Sequence; identical to SEQ ID NO: 94181
  derived and/or modified sequence opt2 from hemagglutinin__InfluenzaA__AEW10734

SEQ ID NO: 99347 - RNA, 1701 nt, Artificial Sequence
  derived and/or modified sequence opt2 from hemagglutinin__InfluenzaA__AEW10744
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccucucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99348 - RNA, 1701 nt, Artificial Sequence; identical to SEQ ID NO: 99347
  derived and/or modified sequence opt2 from hemagglutinin__InfluenzaA__AEW10754

SEQ ID NO: 99349 - RNA, 1701 nt, Artificial Sequence
  derived and/or modified sequence opt2 from hemagglutinin__InfluenzaA__AEW10764
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccaacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99350 - RNA, 1701 nt, Artificial Sequence; identical to SEQ ID NO: 94425
  derived and/or modified sequence opt2 from hemagglutinin__InfluenzaA__AEW10774

SEQ ID NO: 99351 - RNA, 1701 nt, Artificial Sequence; identical to SEQ ID NO: 94168
  derived and/or modified sequence opt2 from hemagglutinin__InfluenzaA__AEW10784

SEQ ID NO: 99352 - RNA, 1701 nt, Artificial Sequence; identical to SEQ ID NO: 94168
  derived and/or modified sequence opt2 from hemagglutinin__InfluenzaA__AEW10794

SEQ ID NO: 99353 - RNA, 1701 nt, Artificial Sequence; identical to SEQ ID NO: 94361
  derived and/or modified sequence opt2 from hemagglutinin__InfluenzaA__AEW10804

SEQ ID NO: 99354 - RNA, 1701 nt, Artificial Sequence; identical to SEQ ID NO: 94179
  derived and/or modified sequence opt2 from hemagglutinin__InfluenzaA__AEW10814

SEQ ID NO: 99355 - RNA, 1701 nt, Artificial Sequence; identical to SEQ ID NO: 94272
  derived and/or modified sequence opt2 from hemagglutinin__InfluenzaA__AEW10824

SEQ ID NO: 99356 - RNA, 1701 nt, Artificial Sequence; identical to SEQ ID NO: 94168
  derived and/or modified sequence opt2 from hemagglutinin__InfluenzaA__AEW10834

SEQ ID NO: 99357 - RNA, 1701 nt, Artificial Sequence; identical to SEQ ID NO: 94361
  derived and/or modified sequence opt2 from hemagglutinin__InfluenzaA__AEW10844

SEQ ID NO: 99358 - RNA, 1701 nt, Artificial Sequence
  derived and/or modified sequence opt2 from hemagglutinin__InfluenzaA__AEW10854
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucaccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99359 - RNA, 1701 nt, Artificial Sequence; identical to SEQ ID NO: 94361
  derived and/or modified sequence opt2 from hemagglutinin__InfluenzaA__AEW10864

SEQ ID NO: 99360 - RNA, 1701 nt, Artificial Sequence; identical to SEQ ID NO: 94361
  derived and/or modified sequence opt2 from hemagglutinin__InfluenzaA__AEW10874

SEQ ID NO: 99361 - RNA, 1701 nt, Artificial Sequence; identical to SEQ ID NO: 94361
  derived and/or modified sequence opt2 from hemagglutinin__InfluenzaA__AEW10884

SEQ ID NO: 99362 - RNA, 1701 nt, Artificial Sequence; identical to SEQ ID NO: 94168
  derived and/or modified sequence opt2 from hemagglutinin__InfluenzaA__AEW10894

SEQ ID NO: 99363 - RNA, 1701 nt, Artificial Sequence; identical to SEQ ID NO: 94361
  derived and/or modified sequence opt2 from hemagglutinin__InfluenzaA__AEW10904

SEQ ID NO: 99364 - RNA, 1701 nt, Artificial Sequence; identical to SEQ ID NO: 94361
  derived and/or modified sequence opt2 from hemagglutinin__InfluenzaA__AEW10914

SEQ ID NO: 99365 - RNA, 1701 nt, Artificial Sequence; identical to SEQ ID NO: 94168
  derived and/or modified sequence opt2 from hemagglutinin__InfluenzaA__AEW10924

SEQ ID NO: 99366 - RNA, 1701 nt, Artificial Sequence; identical to SEQ ID NO: 94168
  derived and/or modified sequence opt2 from hemagglutinin__InfluenzaA__AEW10934

SEQ ID NO: 99367 - RNA, 1701 nt, Artificial Sequence; identical to SEQ ID NO: 94361
  derived and/or modified sequence opt2 from hemagglutinin__InfluenzaA__AEW10944

SEQ ID NO: 99368 - RNA, 1701 nt, Artificial Sequence; identical to SEQ ID NO: 94181
  derived and/or modified sequence opt2 from hemagglutinin__InfluenzaA__AEW10954

SEQ ID NO: 99369 - RNA, 1701 nt, Artificial Sequence; identical to SEQ ID NO: 94181
  derived and/or modified sequence opt2 from hemagglutinin__InfluenzaA__AEW10964

SEQ ID NO: 99370 - RNA, 1701 nt, Artificial Sequence; identical to SEQ ID NO: 94361
  derived and/or modified sequence opt2 from hemagglutinin__InfluenzaA__AEW10974

SEQ ID NO: 99371 - RNA, 1701 nt, Artificial Sequence; identical to SEQ ID NO: 94181
  derived and/or modified sequence opt2 from hemagglutinin__InfluenzaA__AEW10984

SEQ ID NO: 99372 - RNA, 1701 nt, Artificial Sequence; identical to SEQ ID NO: 94181
  derived and/or modified sequence opt2 from hemagglutinin__InfluenzaA__AEW10994

SEQ ID NO: 99373 - RNA, 1701 nt, Artificial Sequence; identical to SEQ ID NO: 94181
  derived and/or modified sequence opt2 from hemagglutinin__InfluenzaA__AEW11004

SEQ ID NO: 99374 - RNA, 1701 nt, Artificial Sequence; identical to SEQ ID NO: 94181
  derived and/or modified sequence opt2 from hemagglutinin__InfluenzaA__AEW11014

SEQ ID NO: 99375 - RNA, 1701 nt, Artificial Sequence; identical to SEQ ID NO: 94181
  derived and/or modified sequence opt2 from hemagglutinin__InfluenzaA__AEW11024

SEQ ID NO: 99376 - RNA, 1701 nt, Artificial Sequence; identical to SEQ ID NO: 94181
  derived and/or modified sequence opt2 from hemagglutinin__InfluenzaA__AEW11034

SEQ ID NO: 99377 - RNA, 1701 nt, Artificial Sequence; identical to SEQ ID NO: 94361
  derived and/or modified sequence opt2 from hemagglutinin__InfluenzaA__AEW11044

SEQ ID NO: 99378 - RNA, 1701 nt, Artificial Sequence; identical to SEQ ID NO: 94181
  derived and/or modified sequence opt2 from hemagglutinin__InfluenzaA__AEW11054

SEQ ID NO: 99379 - RNA, 1701 nt, Artificial Sequence; identical to SEQ ID NO: 94168
  derived and/or modified sequence opt2 from hemagglutinin__InfluenzaA__AEW11064

SEQ ID NO: 99380 - RNA, 1701 nt, Artificial Sequence; identical to SEQ ID NO: 94168
  derived and/or modified sequence opt2 from hemagglutinin__InfluenzaA__AEW11074

SEQ ID NO: 99381 - RNA, 1701 nt, Artificial Sequence
  derived and/or modified sequence opt2 from hemagglutinin__InfluenzaA__AEW11084
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99382 - RNA, 1701 nt, Artificial Sequence; identical to SEQ ID NO: 94168
  derived and/or modified sequence opt2 from hemagglutinin__InfluenzaA__AEW11094

SEQ ID NO: 99383 - RNA, 1701 nt, Artificial Sequence; identical to SEQ ID NO: 94168
  derived and/or modified sequence opt2 from hemagglutinin__InfluenzaA__AEW11104

SEQ ID NO: 99384 - RNA, 1701 nt, Artificial Sequence; identical to SEQ ID NO: 94181
  derived and/or modified sequence opt2 from hemagglutinin__InfluenzaA__AEW11114

SEQ ID NO: 99385 - RNA, 1701 nt, Artificial Sequence
  derived and/or modified sequence opt2 from hemagglutinin__InfluenzaA__AEW11124
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguucgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99386 - RNA, 1701 nt, Artificial Sequence
  derived and/or modified sequence opt2 from hemagglutinin__InfluenzaA__AEW11134
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaacaaggaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99387 - RNA, 1701 nt, Artificial Sequence; identical to SEQ ID NO: 94181
  derived and/or modified sequence opt2 from hemagglutinin__InfluenzaA__AEW11144

SEQ ID NO: 99388 - RNA, 1701 nt, Artificial Sequence; identical to SEQ ID NO: 94181
  derived and/or modified sequence opt2 from hemagglutinin__InfluenzaA__AEW11154

SEQ ID NO: 99389 - RNA, 1701 nt, Artificial Sequence; identical to SEQ ID NO: 99381
  derived and/or modified sequence opt2 from hemagglutinin__InfluenzaA__AEW11164

SEQ ID NO: 99390 - RNA, 1701 nt, Artificial Sequence; identical to SEQ ID NO: 99381
  derived and/or modified sequence opt2 from hemagglutinin__InfluenzaA__AEW11174

SEQ ID NO: 99391 - RNA, 1701 nt, Artificial Sequence; identical to SEQ ID NO: 94181
  derived and/or modified sequence opt2 from hemagglutinin__InfluenzaA__AEW11184

SEQ ID NO: 99392 - RNA, 1701 nt, Artificial Sequence; identical to SEQ ID NO: 94168
  derived and/or modified sequence opt2 from hemagglutinin__InfluenzaA__AEW11194

SEQ ID NO: 99393 - RNA, 1701 nt, Artificial Sequence; identical to SEQ ID NO: 94181
  derived and/or modified sequence opt2 from hemagglutinin__InfluenzaA__AEW11204

SEQ ID NO: 99394 - RNA, 1701 nt, Artificial Sequence; identical to SEQ ID NO: 94181
  derived and/or modified sequence opt2 from hemagglutinin__InfluenzaA__AEW11214

SEQ ID NO: 99395 - RNA, 1701 nt, Artificial Sequence; identical to SEQ ID NO: 94361
  derived and/or modified sequence opt2 from hemagglutinin__InfluenzaA__AEW11224

SEQ ID NO: 99396 - RNA, 1701 nt, Artificial Sequence; identical to SEQ ID NO: 94181
  derived and/or modified sequence opt2 from hemagglutinin__InfluenzaA__AEW11234

SEQ ID NO: 99397 - RNA, 1701 nt, Artificial Sequence; identical to SEQ ID NO: 94181
  derived and/or modified sequence opt2 from hemagglutinin__InfluenzaA__AEW11244

SEQ ID NO: 99398 - RNA, 1701 nt, Artificial Sequence
  derived and/or modified sequence opt2 from hemagglutinin__InfluenzaA__AEW11254
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccuccacgccggcgccaaguccuucuacaagaaccucaucuggcucgucaagaagggcaacuccuaccccaagcucuccaaguccuacaucaacgacaagggcaaggagguccucguccucuggggcauccaccaccccuccgccuccgccgaccagcagucccucuaccagaacgccgacgccuacgucuucgucggcuccucccgcuacuccaagaaggucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99399 - RNA, 1701 nt, Artificial Sequence; identical to SEQ ID NO: 94168
  derived and/or modified sequence opt2 from hemagglutinin__InfluenzaA__AEW11263

SEQ ID NO: 99400 - RNA, 1701 nt, Artificial Sequence; identical to SEQ ID NO: 94168
  derived and/or modified sequence opt2 from hemagglutinin__InfluenzaA__AEW11273

SEQ ID NO: 99401 - RNA, 1701 nt, Artificial Sequence; identical to SEQ ID NO: 94168
  derived and/or modified sequence opt2 from hemagglutinin__InfluenzaA__AEW11283

SEQ ID NO: 99402 - RNA, 1701 nt, Artificial Sequence; identical to SEQ ID NO: 94168
  derived and/or modified sequence opt2 from hemagglutinin__InfluenzaA__AEW11293

SEQ ID NO: 99403 - RNA, 1701 nt, Artificial Sequence
  derived and/or modified sequence opt2 from hemagglutinin__InfluenzaA__AEW11303
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcgucugcaucuga

SEQ ID NO: 99404 - RNA, 1701 nt, Artificial Sequence; identical to SEQ ID NO: 94168
  derived and/or modified sequence opt2 from hemagglutinin__InfluenzaA__AEW11313

SEQ ID NO: 99405 - RNA, 1701 nt, Artificial Sequence
  derived and/or modified sequence opt2 from hemagglutinin__InfluenzaA__AEW11323
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99406 - RNA, 1701 nt, Artificial Sequence
  derived and/or modified sequence opt2 from hemagglutinin__InfluenzaA__AEW22712
augaaggccauccucgucguccuccucuacaccuucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99407 - RNA, 1701 nt, Artificial Sequence
  derived and/or modified sequence opt2 from hemagglutinin__InfluenzaA__AEW22718
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99408 - RNA, 1701 nt, Artificial Sequence; identical to SEQ ID NO: 97966
  derived and/or modified sequence opt2 from hemagglutinin__InfluenzaA__AEW22720

SEQ ID NO: 99409 - RNA, 1701 nt, Artificial Sequence; identical to SEQ ID NO: 97966
  derived and/or modified sequence opt2 from hemagglutinin__InfluenzaA__AEW22722

SEQ ID NO: 99410 - RNA, 1701 nt, Artificial Sequence
  derived and/or modified sequence opt2 from hemagglutinin__InfluenzaA__AEW22724
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgcccgcgagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99411 - RNA, 1701 nt, Artificial Sequence
  derived and/or modified sequence opt2 from hemagglutinin__InfluenzaA__AEW25297
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccccggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccccccgcggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99412 - RNA, 1701 nt, Artificial Sequence; identical to SEQ ID NO: 94979
  derived and/or modified sequence opt2 from hemagglutinin__InfluenzaA__AEW25306

SEQ ID NO: 99413 - RNA, 1701 nt, Artificial Sequence
  derived and/or modified sequence opt2 from hemagglutinin__InfluenzaA__AEW25315
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucugggucugcuccaacggcucccuccagugccgcaucugcaucuga

SEQ ID NO: 99414 - RNA, 1701 nt, Artificial Sequence
  derived and/or modified sequence opt2 from hemagglutinin__InfluenzaA__AEW25331
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacaucccccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99415 - RNA, 1701 nt, Artificial Sequence
  derived and/or modified sequence opt2 from hemagglutinin__InfluenzaA__AEW25349
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99416 - RNA, 1701 nt, Artificial Sequence
  derived and/or modified sequence opt2 from hemagglutinin__InfluenzaA__AEW25367
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagcgccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacaccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99417 - RNA, 1701 nt, Artificial Sequence
  derived and/or modified sequence opt2 from hemagglutinin__InfluenzaA__AEW25377
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacgccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99418 - RNA, 1701 nt, Artificial Sequence
  derived and/or modified sequence opt2 from hemagglutinin__InfluenzaA__AEW25385
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccguccccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99419 - RNA, 1701 nt, Artificial Sequence; identical to SEQ ID NO: 99415
  derived and/or modified sequence opt2 from hemagglutinin__InfluenzaA__AEW25416

SEQ ID NO: 99420 - RNA, 1701 nt, Artificial Sequence
  derived and/or modified sequence opt2 from hemagglutinin__InfluenzaA__AEW25446
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacaagcaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99421 - RNA, 1701 nt, Artificial Sequence; identical to SEQ ID NO: 99415
  derived and/or modified sequence opt2 from hemagglutinin__InfluenzaA__AEW25454

SEQ ID NO: 99422 - RNA, 1701 nt, Artificial Sequence
  derived and/or modified sequence opt2 from hemagglutinin__InfluenzaA__AEW25462
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaagcccuacaccaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99423 - RNA, 1701 nt, Artificial Sequence; identical to SEQ ID NO: 94979
  derived and/or modified sequence opt2 from hemagglutinin__InfluenzaA__AEW25472

SEQ ID NO: 99424 - RNA, 1701 nt, Artificial Sequence
  derived and/or modified sequence opt2 from hemagglutinin__InfluenzaA__AEW25482
augaaggccauccucgucguccuccucuacaccuucgccaccgccaacgccgacacccucugcaucggcuaccacgccaacaacuccaccgacaccgucgacaccguccucgagaagaaggucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccagggcggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgagcucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99425 - RNA, 1701 nt, Artificial Sequence
  derived and/or modified sequence opt2 from hemagglutinin__InfluenzaA__AEW25492
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacaucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99426 - RNA, 1701 nt, Artificial Sequence
  derived and/or modified sequence opt2 from hemagglutinin__InfluenzaA__AEW25501
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucugccucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99427 - RNA, 1701 nt, Artificial Sequence; identical to SEQ ID NO: 99415
  derived and/or modified sequence opt2 from hemagglutinin__InfluenzaA__AEW25509

SEQ ID NO: 99428 - RNA, 1701 nt, Artificial Sequence
  derived and/or modified sequence opt2 from hemagglutinin__InfluenzaA__AEW25519
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacaccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99429 - RNA, 1701 nt, Artificial Sequence
  derived and/or modified sequence opt2 from hemagglutinin__InfluenzaA__AEW25528
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgaguccuucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagcgccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99430 - RNA, 1701 nt, Artificial Sequence
  derived and/or modified sequence opt2 from hemagglutinin__InfluenzaA__AEW25545
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcuccuacgacuaccccaaguacuccgaggaggccaagcucaaccgcgaggagaucgacggcgucaagcucgaguccacccgcaucuaccagauccucgccaucuacuccaccgucgccuccucccucgucauggucgucucccucggcgccaucuccuucuggaugugcuccaacggcucccuccagugccgcaucugcaucuga

SEQ ID NO: 99431 - RNA, 1701 nt, Artificial Sequence
  derived and/or modified sequence opt2 from hemagglutinin__InfluenzaA__AEW25555
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacuacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99432 - RNA, 1701 nt, Artificial Sequence
  derived and/or modified sequence opt2 from hemagglutinin__InfluenzaA__AEW25564
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgcccucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaaccgcaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccggcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99433 - RNA, 1701 nt, Artificial Sequence; identical to SEQ ID NO: 94979
  derived and/or modified sequence opt2 from hemagglutinin__InfluenzaA__AEW25573

SEQ ID NO: 99434 - RNA, 1701 nt, Artificial Sequence
  derived and/or modified sequence opt2 from hemagglutinin__InfluenzaA__AEW25582
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucauccucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacggccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99435 - RNA, 1701 nt, Artificial Sequence
  derived and/or modified sequence opt2 from hemagglutinin__InfluenzaA__AEW25590
augaaggccauccucgucguccuccucuacaccuucgccaccgccaacgccgacacccucugcaucggcuaccacgccaacaacuccaccgacaccgucgacaccguccucgagaagaacgucaccgucacccaguccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggaggcccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccuccacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99436 - RNA, 1701 nt, Artificial Sequence; identical to SEQ ID NO: 94979
  derived and/or modified sequence opt2 from hemagglutinin__InfluenzaA__AEW25600

SEQ ID NO: 99437 - RNA, 1701 nt, Artificial Sequence; identical to SEQ ID NO: 94979
  derived and/or modified sequence opt2 from hemagglutinin__InfluenzaA__AEW25620

SEQ ID NO: 99438 - RNA, 1701 nt, Artificial Sequence
  derived and/or modified sequence opt2 from hemagglutinin__InfluenzaA__AEW25629
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccgaggccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99439 - RNA, 1701 nt, Artificial Sequence; identical to SEQ ID NO: 94181
  derived and/or modified sequence opt2 from hemagglutinin__InfluenzaA__AEW25637

SEQ ID NO: 99440 - RNA, 1701 nt, Artificial Sequence
  derived and/or modified sequence opt2 from hemagglutinin__InfluenzaA__AEW25646
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99441 - RNA, 1701 nt, Artificial Sequence
  derived and/or modified sequence opt2 from hemagglutinin__InfluenzaA__AEW25654
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccuccccccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99442 - RNA, 1701 nt, Artificial Sequence
  derived and/or modified sequence opt2 from hemagglutinin__InfluenzaA__AEW25662
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99443 - RNA, 1701 nt, Artificial Sequence
  derived and/or modified sequence opt2 from hemagglutinin__InfluenzaA__AEW25669
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgagggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99444 - RNA, 1701 nt, Artificial Sequence
  derived and/or modified sequence opt2 from hemagglutinin__InfluenzaA__AEW25678
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccuccgcgccaucuccuucuggaugugcuccaacggcucccuccagugccgcaucugcaucuga

SEQ ID NO: 99445 - RNA, 1701 nt, Artificial Sequence
  derived and/or modified sequence opt2 from hemagglutinin__InfluenzaA__AEW25687
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugccccuacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99446 - RNA, 1701 nt, Artificial Sequence; identical to SEQ ID NO: 99415
  derived and/or modified sequence opt2 from hemagglutinin__InfluenzaA__AEW25696

SEQ ID NO: 99447 - RNA, 1701 nt, Artificial Sequence; identical to SEQ ID NO: 94979
  derived and/or modified sequence opt2 from hemagglutinin__InfluenzaA__AEW25706

SEQ ID NO: 99448 - RNA, 1695 nt, Artificial Sequence
  derived and/or modified sequence opt2 from hemagglutinin__InfluenzaA__AEW91908
auggagaagaucguccuccucuucgccaccaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaagaacuccugguccgaccacgaggccucccucggcgucuccgccgccugccccuaccagggcaaguccuccuucuuccgcaacgucgucuggcucaucaagaaggacaacgccuaccccaccaucaagaagggcuacaacaacaccaaccaggaggaccuccucguccucuggggcauccaccaccccaacgacgaggccgagcagacccgccucuaccagaaccccaccaccuacaucuccaucggcaccuccacccucaaccagcgccucguccccaagaucgccacccgcuccaagaucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugaaguccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagggcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacguccgcaaccucuacgacaagguccgccuccagcucaaggacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 99449 - RNA, 1701 nt, Artificial Sequence
  derived and/or modified sequence opt2 from hemagglutinin__InfluenzaA__AEX09175
augaaggccauccucgucguccuccucuacaccuucgccaccgccaacgccgacacccucugcaucggcuaccacgccaacaacuccaccgacaccgucgacaccguccucgagaagaacgucgccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99450 - RNA, 1701 nt, Artificial Sequence; identical to SEQ ID NO: 94181
  derived and/or modified sequence opt2 from hemagglutinin__InfluenzaA__AEX25795

SEQ ID NO: 99451 - RNA, 1701 nt, Artificial Sequence
  derived and/or modified sequence opt2 from hemagglutinin__InfluenzaA__AEX25797
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99452 - RNA, 1701 nt, Artificial Sequence
  derived and/or modified sequence opt2 from hemagglutinin__InfluenzaA__AEX25798
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99453 - RNA, 1701 nt, Artificial Sequence; identical to SEQ ID NO: 94181
  derived and/or modified sequence opt2 from hemagglutinin__InfluenzaA__AEX25800

SEQ ID NO: 99454 - RNA, 1701 nt, Artificial Sequence; identical to SEQ ID NO: 94181
  derived and/or modified sequence opt2 from hemagglutinin__InfluenzaA__AEX25803

SEQ ID NO: 99455 - RNA, 1701 nt, Artificial Sequence; identical to SEQ ID NO: 94423
  derived and/or modified sequence opt2 from hemagglutinin__InfluenzaA__AEX25808

SEQ ID NO: 99456 - RNA, 1701 nt, Artificial Sequence; identical to SEQ ID NO: 97151
  derived and/or modified sequence opt2 from hemagglutinin__InfluenzaA__AEX25810

SEQ ID NO: 99457 - RNA, 1701 nt, Artificial Sequence
  derived and/or modified sequence opt2 from hemagglutinin__InfluenzaA__AEX25811
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuucaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaaggccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99458 - RNA, 1701 nt, Artificial Sequence; identical to SEQ ID NO: 97151
  derived and/or modified sequence opt2 from hemagglutinin__InfluenzaA__AEX25814

SEQ ID NO: 99459 - RNA, 1701 nt, Artificial Sequence
  derived and/or modified sequence opt2 from hemagglutinin__InfluenzaA__AEX25816
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99460 - RNA, 1701 nt, Artificial Sequence
  derived and/or modified sequence opt2 from hemagglutinin__InfluenzaA__AEX25818
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccaguccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99461 - RNA, 1701 nt, Artificial Sequence
  derived and/or modified sequence opt2 from hemagglutinin__InfluenzaA__AEX25824
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucgaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99462 - RNA, 1698 nt, Artificial Sequence
  derived and/or modified sequence opt2 from hemagglutinin__InfluenzaA__AEX33420
augaaggucaagcuccucguccuccucugcaucuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaaguccggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacgucaaguccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99463 - RNA, 1701 nt, Artificial Sequence
  derived and/or modified sequence opt2 from hemagglutinin__InfluenzaA__AEX33453
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99464 - RNA, 1701 nt, Artificial Sequence; identical to SEQ ID NO: 93307
  derived and/or modified sequence opt2 from hemagglutinin__InfluenzaA__AEX33464

SEQ ID NO: 99465 - RNA, 1701 nt, Artificial Sequence; identical to SEQ ID NO: 93307
  derived and/or modified sequence opt2 from hemagglutinin__InfluenzaA__AEX33475

SEQ ID NO: 99466 - RNA, 1701 nt, Artificial Sequence; identical to SEQ ID NO: 93307
  derived and/or modified sequence opt2 from hemagglutinin__InfluenzaA__AEX33486

SEQ ID NO: 99467 - RNA, 1701 nt, Artificial Sequence; identical to SEQ ID NO: 93307
  derived and/or modified sequence opt2 from hemagglutinin__InfluenzaA__AEX33497

SEQ ID NO: 99468 - RNA, 1701 nt, Artificial Sequence; identical to SEQ ID NO: 93307
  derived and/or modified sequence opt2 from hemagglutinin__InfluenzaA__AEX33508

SEQ ID NO: 99469 - RNA, 1701 nt, Artificial Sequence; identical to SEQ ID NO: 93307
  derived and/or modified sequence opt2 from hemagglutinin__InfluenzaA__AEX33519

SEQ ID NO: 99470 - RNA, 1701 nt, Artificial Sequence
  derived and/or modified sequence opt2 from hemagglutinin__InfluenzaA__AEX33541
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccuccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99471 - RNA, 1701 nt, Artificial Sequence
  derived and/or modified sequence opt2 from hemagglutinin__InfluenzaA__AEX33574
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgacugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99472 - RNA, 1701 nt, Artificial Sequence; identical to SEQ ID NO: 93307
  derived and/or modified sequence opt2 from hemagglutinin__InfluenzaA__AEX33585

SEQ ID NO: 99473 - RNA, 1701 nt, Artificial Sequence
  derived and/or modified sequence opt2 from hemagglutinin__InfluenzaA__AEX33596
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99474 - RNA, 1701 nt, Artificial Sequence; identical to SEQ ID NO: 93307
  derived and/or modified sequence opt2 from hemagglutinin__InfluenzaA__AEX33618

SEQ ID NO: 99475 - RNA, 1701 nt, Artificial Sequence; identical to SEQ ID NO: 93307
  derived and/or modified sequence opt2 from hemagglutinin__InfluenzaA__AEX33629

SEQ ID NO: 99476 - RNA, 1701 nt, Artificial Sequence; identical to SEQ ID NO: 99473
  derived and/or modified sequence opt2 from hemagglutinin__InfluenzaA__AEX33640

SEQ ID NO: 99477 - RNA, 1701 nt, Artificial Sequence
  derived and/or modified sequence opt2 from hemagglutinin__InfluenzaA__AEX33836
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacaucuuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99478 - RNA, 1701 nt, Artificial Sequence; identical to SEQ ID NO: 92142
  derived and/or modified sequence opt2 from hemagglutinin__InfluenzaA__AEX33880

SEQ ID NO: 99479 - RNA, 1698 nt, Artificial Sequence
  derived and/or modified sequence opt2 from hemagglutinin__InfluenzaA__AEX33913
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggagaacuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaagaagaaggagguccucguccucuggggcguccaccacccccccaacaucggcaaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaaguucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99480 - RNA, 1698 nt, Artificial Sequence
  derived and/or modified sequence opt2 from hemagglutinin__InfluenzaA__AEX33924
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucucccgcgaguccugguccuacaucgucgagaagcccucccccgagaacggcaccugcuaccccggccacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccagaagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99481 - RNA, 1701 nt, Artificial Sequence
  derived and/or modified sequence opt2 from hemagglutinin__InfluenzaA__AEX33957
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccaggucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99482 - RNA, 1701 nt, Artificial Sequence
  derived and/or modified sequence opt2 from hemagglutinin__InfluenzaA__AEX33968
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccuccacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99483 - RNA, 1701 nt, Artificial Sequence
  derived and/or modified sequence opt2 from hemagglutinin__InfluenzaA__AEX33979
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaacggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99484 - RNA, 1701 nt, Artificial Sequence
  derived and/or modified sequence opt2 from hemagglutinin__InfluenzaA__AEX33990
augaagaccaucaucgcccucuccuacauccucuaccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaggacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99485 - RNA, 1701 nt, Artificial Sequence
  derived and/or modified sequence opt2 from hemagglutinin__InfluenzaA__AEX34001
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacuccgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacgccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99486 - RNA, 1701 nt, Artificial Sequence
  derived and/or modified sequence opt2 from hemagglutinin__InfluenzaA__AEX34012
augaagaccaucaucgcccucuccuacauccucuaccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99487 - RNA, 1701 nt, Artificial Sequence; identical to SEQ ID NO: 93946
  derived and/or modified sequence opt2 from hemagglutinin__InfluenzaA__AEX34023

SEQ ID NO: 99488 - RNA, 1701 nt, Artificial Sequence
  derived and/or modified sequence opt2 from hemagglutinin__InfluenzaA__AEX34044
augaagaccaucaucgccuucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99489 - RNA, 1701 nt, Artificial Sequence
  derived and/or modified sequence opt2 from hemagglutinin__InfluenzaA__AEX34089
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccuccaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99490 - RNA, 1701 nt, Artificial Sequence
  derived and/or modified sequence opt2 from hemagglutinin__InfluenzaA__AEX34123
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99491 - RNA, 1701 nt, Artificial Sequence
  derived and/or modified sequence opt2 from hemagglutinin__InfluenzaA__AEX34134
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99492 - RNA, 1701 nt, Artificial Sequence; identical to SEQ ID NO: 99490
  derived and/or modified sequence opt2 from hemagglutinin__InfluenzaA__AEX34145

SEQ ID NO: 99493 - RNA, 1701 nt, Artificial Sequence
  derived and/or modified sequence opt2 from hemagglutinin__InfluenzaA__AEX34156
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcggcuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99494 - RNA, 1701 nt, Artificial Sequence; identical to SEQ ID NO: 93440
  derived and/or modified sequence opt2 from hemagglutinin__InfluenzaA__AEX34178

SEQ ID NO: 99495 - RNA, 1701 nt, Artificial Sequence
  derived and/or modified sequence opt2 from hemagglutinin__InfluenzaA__AEX34188
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 99496 - RNA, 1701 nt, Artificial Sequence; identical to SEQ ID NO: 93946
  derived and/or modified sequence opt2 from hemagglutinin__InfluenzaA__AEX34199

SEQ ID NO: 99497 - RNA, 1701 nt, Artificial Sequence
  derived and/or modified sequence opt2 from hemagglutinin__InfluenzaA__AEX34221
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcgacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99498 - RNA, 1701 nt, Artificial Sequence; identical to SEQ ID NO: 93440
  derived and/or modified sequence opt2 from hemagglutinin__InfluenzaA__AEX34243

SEQ ID NO: 99499 - RNA, 1701 nt, Artificial Sequence; identical to SEQ ID NO: 99495
  derived and/or modified sequence opt2 from hemagglutinin__InfluenzaA__AEX34254

SEQ ID NO: 99500 - RNA, 1701 nt, Artificial Sequence; identical to SEQ ID NO: 93440
  derived and/or modified sequence opt2 from hemagglutinin__InfluenzaA__AEX34265

SEQ ID NO: 99501 - RNA, 1701 nt, Artificial Sequence
  derived and/or modified sequence opt2 from hemagglutinin__InfluenzaA__AEX34275
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccuccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99502 - RNA, 1698 nt, Artificial Sequence; identical to SEQ ID NO: 94000
  derived and/or modified sequence opt2 from hemagglutinin__InfluenzaA__AEX34318

SEQ ID NO: 99503 - RNA, 1698 nt, Artificial Sequence
  derived and/or modified sequence opt2 from hemagglutinin__InfluenzaA__AEX34329
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucgucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgagggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99504 - RNA, 1701 nt, Artificial Sequence
  derived and/or modified sequence opt2 from hemagglutinin__InfluenzaA__AEX34352
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccucaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99505 - RNA, 1701 nt, Artificial Sequence; identical to SEQ ID NO: 93946
  derived and/or modified sequence opt2 from hemagglutinin__InfluenzaA__AEX34364

SEQ ID NO: 99506 - RNA, 1701 nt, Artificial Sequence; identical to SEQ ID NO: 93946
  derived and/or modified sequence opt2 from hemagglutinin__InfluenzaA__AEX34375

SEQ ID NO: 99507 - RNA, 1701 nt, Artificial Sequence
  derived and/or modified sequence opt2 from hemagglutinin__InfluenzaA__AEX34386
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99508 - RNA, 1701 nt, Artificial Sequence
  derived and/or modified sequence opt2 from hemagglutinin__InfluenzaA__AEX34407
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99509 - RNA, 1698 nt, Artificial Sequence
  derived and/or modified sequence opt2 from hemagglutinin__InfluenzaA__AEX34440
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaccucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99510 - RNA, 1698 nt, Artificial Sequence; identical to SEQ ID NO: 91811
  derived and/or modified sequence opt2 from hemagglutinin__InfluenzaA__AEX34462

SEQ ID NO: 99511 - RNA, 1698 nt, Artificial Sequence
  derived and/or modified sequence opt2 from hemagglutinin__InfluenzaA__AEX34473
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaaguccggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacgucaaguccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccaguccgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99512 - RNA, 1698 nt, Artificial Sequence
  derived and/or modified sequence opt2 from hemagglutinin__InfluenzaA__AEX34495
augaaggucaagcuccucguccuccucugcaucuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaaguccggccucuaccccaaccucuccaaguccuacgccaacaacaaggagaaggagguccucguccucuggggcguccaccacccccccaacaucggcguccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacgucaaguccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99513 - RNA, 1698 nt, Artificial Sequence; identical to SEQ ID NO: 99512
  derived and/or modified sequence opt2 from hemagglutinin__InfluenzaA__AEX34506

SEQ ID NO: 99514 - RNA, 1698 nt, Artificial Sequence; identical to SEQ ID NO: 99512
  derived and/or modified sequence opt2 from hemagglutinin__InfluenzaA__AEX34517

SEQ ID NO: 99515 - RNA, 1698 nt, Artificial Sequence; identical to SEQ ID NO: 99512
  derived and/or modified sequence opt2 from hemagglutinin__InfluenzaA__AEX34528

SEQ ID NO: 99516 - RNA, 1698 nt, Artificial Sequence; identical to SEQ ID NO: 99512
  derived and/or modified sequence opt2 from hemagglutinin__InfluenzaA__AEX34539

SEQ ID NO: 99517 - RNA, 1698 nt, Artificial Sequence; identical to SEQ ID NO: 99512
  derived and/or modified sequence opt2 from hemagglutinin__InfluenzaA__AEX34550

SEQ ID NO: 99518 - RNA, 1698 nt, Artificial Sequence; identical to SEQ ID NO: 99512
  derived and/or modified sequence opt2 from hemagglutinin__InfluenzaA__AEX34561

SEQ ID NO: 99519 - RNA, 1698 nt, Artificial Sequence; identical to SEQ ID NO: 99512
  derived and/or modified sequence opt2 from hemagglutinin__InfluenzaA__AEX34572

SEQ ID NO: 99520 - RNA, 1698 nt, Artificial Sequence; identical to SEQ ID NO: 99512
  derived and/or modified sequence opt2 from hemagglutinin__InfluenzaA__AEX34583

SEQ ID NO: 99521 - RNA, 1698 nt, Artificial Sequence; identical to SEQ ID NO: 99512
  derived and/or modified sequence opt2 from hemagglutinin__InfluenzaA__AEX34594

SEQ ID NO: 99522 - RNA, 1698 nt, Artificial Sequence; identical to SEQ ID NO: 99512
  derived and/or modified sequence opt2 from hemagglutinin__InfluenzaA__AEX34605

SEQ ID NO: 99523 - RNA, 1698 nt, Artificial Sequence; identical to SEQ ID NO: 99512
  derived and/or modified sequence opt2 from hemagglutinin__InfluenzaA__AEX34616

SEQ ID NO: 99524 - RNA, 1698 nt, Artificial Sequence; identical to SEQ ID NO: 99512
  derived and/or modified sequence opt2 from hemagglutinin__InfluenzaA__AEX34627

SEQ ID NO: 99525 - RNA, 1698 nt, Artificial Sequence; identical to SEQ ID NO: 99512
  derived and/or modified sequence opt2 from hemagglutinin__InfluenzaA__AEX34638

SEQ ID NO: 99526 - RNA, 1698 nt, Artificial Sequence
  derived and/or modified sequence opt2 from hemagglutinin__InfluenzaA__AEX34650
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcucccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99527 - RNA, 1698 nt, Artificial Sequence
  derived and/or modified sequence opt2 from hemagglutinin__InfluenzaA__AEX34661
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaagggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaagaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99528 - RNA, 1698 nt, Artificial Sequence
  derived and/or modified sequence opt2 from hemagglutinin__InfluenzaA__AEX34672
augaaggucaagcuccucguccuccucugcaccuucaccgccaccuacgccgacaccaucugcaucggcuaccacgccaacaacuccaccgacaccgucgacaccguccucgacaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacgacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcguccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99529 - RNA, 1698 nt, Artificial Sequence
  derived and/or modified sequence opt2 from hemagglutinin__InfluenzaA__AEX34683
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccuaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuucggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99530 - RNA, 1698 nt, Artificial Sequence
  derived and/or modified sequence opt2 from hemagglutinin__InfluenzaA__AEX34757
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcggcuccuccuucuacaagaaccuccucuggcucacccgcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99531 - RNA, 1698 nt, Artificial Sequence
  derived and/or modified sequence opt2 from hemagglutinin__InfluenzaA__AEX34768
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggacuccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccagggcggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99532 - RNA, 1698 nt, Artificial Sequence
  derived and/or modified sequence opt2 from hemagglutinin__InfluenzaA__AEX34779
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagcgcuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99533 - RNA, 1698 nt, Artificial Sequence; identical to SEQ ID NO: 95609
  derived and/or modified sequence opt2 from hemagglutinin__InfluenzaA__AEX34790

SEQ ID NO: 99534 - RNA, 1698 nt, Artificial Sequence
  derived and/or modified sequence opt2 from hemagglutinin__InfluenzaA__AEX34801
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcgccugcuaccccggccacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccgacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99535 - RNA, 1698 nt, Artificial Sequence
  derived and/or modified sequence opt2 from hemagglutinin__InfluenzaA__AEX34812
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99536 - RNA, 1698 nt, Artificial Sequence
  derived and/or modified sequence opt2 from hemagglutinin__InfluenzaA__AEX34834
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaacuccaaggaguccugguccuacaucgucgagaagcccaaccccgagaacggcaccugcuaccccggccacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucaccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99537 - RNA, 1698 nt, Artificial Sequence
  derived and/or modified sequence opt2 from hemagglutinin__InfluenzaA__AEX34845
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucguccccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgagggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99538 - RNA, 1698 nt, Artificial Sequence; identical to SEQ ID NO: 95609
  derived and/or modified sequence opt2 from hemagglutinin__InfluenzaA__AEX34856

SEQ ID NO: 99539 - RNA, 1698 nt, Artificial Sequence
  derived and/or modified sequence opt2 from hemagglutinin__InfluenzaA__AEX34867
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucgucuccaaggaguccugguccuacaucgucgagaagcccaaccccgagaacggcaccugcuaccccggccacuucgccgacuacgaggagcuccgcgagcagcucaucuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgagggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99540 - RNA, 1698 nt, Artificial Sequence; identical to SEQ ID NO: 95609
  derived and/or modified sequence opt2 from hemagglutinin__InfluenzaA__AEX34878

SEQ ID NO: 99541 - RNA, 1698 nt, Artificial Sequence
  derived and/or modified sequence opt2 from hemagglutinin__InfluenzaA__AEX34889
augaaggucaaccuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99542 - RNA, 1698 nt, Artificial Sequence
  derived and/or modified sequence opt2 from hemagglutinin__InfluenzaA__AEX34900
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcgucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucgagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99543 - RNA, 1698 nt, Artificial Sequence
  derived and/or modified sequence opt2 from hemagglutinin__InfluenzaA__AEX34911
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucucccaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucggcuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99544 - RNA, 1698 nt, Artificial Sequence
  derived and/or modified sequence opt2 from hemagglutinin__InfluenzaA__AEX34922
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucgacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99545 - RNA, 1698 nt, Artificial Sequence; identical to SEQ ID NO: 94000
  derived and/or modified sequence opt2 from hemagglutinin__InfluenzaA__AEX34933

SEQ ID NO: 99546 - RNA, 1698 nt, Artificial Sequence; identical to SEQ ID NO: 94000
  derived and/or modified sequence opt2 from hemagglutinin__InfluenzaA__AEX34944

SEQ ID NO: 99547 - RNA, 1698 nt, Artificial Sequence
  derived and/or modified sequence opt2 from hemagglutinin__InfluenzaA__AEX34955
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99548 - RNA, 1698 nt, Artificial Sequence
  derived and/or modified sequence opt2 from hemagglutinin__InfluenzaA__AEX34966
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucauguucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99549 - RNA, 1698 nt, Artificial Sequence; identical to SEQ ID NO: 99548
  derived and/or modified sequence opt2 from hemagglutinin__InfluenzaA__AEX34977

SEQ ID NO: 99550 - RNA, 1698 nt, Artificial Sequence; identical to SEQ ID NO: 99548
  derived and/or modified sequence opt2 from hemagglutinin__InfluenzaA__AEX34988

SEQ ID NO: 99551 - RNA, 1698 nt, Artificial Sequence; identical to SEQ ID NO: 95609
  derived and/or modified sequence opt2 from hemagglutinin__InfluenzaA__AEX34999

SEQ ID NO: 99552 - RNA, 1698 nt, Artificial Sequence; identical to SEQ ID NO: 99548
  derived and/or modified sequence opt2 from hemagglutinin__InfluenzaA__AEX35010

SEQ ID NO: 99553 - RNA, 1698 nt, Artificial Sequence; identical to SEQ ID NO: 99548
  derived and/or modified sequence opt2 from hemagglutinin__InfluenzaA__AEX35032

SEQ ID NO: 99554 - RNA, 1698 nt, Artificial Sequence; identical to SEQ ID NO: 99548
  derived and/or modified sequence opt2 from hemagglutinin__InfluenzaA__AEX35043

SEQ ID NO: 99555 - RNA, 1698 nt, Artificial Sequence
  derived and/or modified sequence opt2 from hemagglutinin__InfluenzaA__AEX35054
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucauguucgaggccaacggcaaccucaucgccccccgcuacgccuucgcccucaaccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99556 - RNA, 1698 nt, Artificial Sequence; identical to SEQ ID NO: 99548
  derived and/or modified sequence opt2 from hemagglutinin__InfluenzaA__AEX35065

SEQ ID NO: 99557 - RNA, 1698 nt, Artificial Sequence; identical to SEQ ID NO: 94000
  derived and/or modified sequence opt2 from hemagglutinin__InfluenzaA__AEX35076

SEQ ID NO: 99558 - RNA, 1698 nt, Artificial Sequence
  derived and/or modified sequence opt2 from hemagglutinin__InfluenzaA__AEX35087
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99559 - RNA, 1698 nt, Artificial Sequence
  derived and/or modified sequence opt2 from hemagglutinin__InfluenzaA__AEX35098
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucauguccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99560 - RNA, 1698 nt, Artificial Sequence
  derived and/or modified sequence opt2 from hemagglutinin__InfluenzaA__AEX35109
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccagccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99561 - RNA, 1698 nt, Artificial Sequence
  derived and/or modified sequence opt2 from hemagglutinin__InfluenzaA__AEX35120
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccgcgagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99562 - RNA, 1698 nt, Artificial Sequence; identical to SEQ ID NO: 99305
  derived and/or modified sequence opt2 from hemagglutinin__InfluenzaA__AEX35131

SEQ ID NO: 99563 - RNA, 1698 nt, Artificial Sequence; identical to SEQ ID NO: 99305
  derived and/or modified sequence opt2 from hemagglutinin__InfluenzaA__AEX35142

SEQ ID NO: 99564 - RNA, 1698 nt, Artificial Sequence
  derived and/or modified sequence opt2 from hemagglutinin__InfluenzaA__AEX35153
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccuccggcaaccucaucgccccccgcuacgccuucgcccucucccgcggcuucggcuccggcaucaucaacuccaacgcccccauggacgagugcgacgccaagugccagaccccccagggcgccaucaacuccaaccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagucccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99565 - RNA, 1698 nt, Artificial Sequence
  derived and/or modified sequence opt2 from hemagglutinin__InfluenzaA__AEX35164
augaaggucaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99566 - RNA, 1698 nt, Artificial Sequence
  derived and/or modified sequence opt2 from hemagglutinin__InfluenzaA__AEX35175
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucgaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucaccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucaaccgcggcuucggcuccggcaucaucaccuccaacgcccccauggacggcugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99567 - RNA, 1698 nt, Artificial Sequence
  derived and/or modified sequence opt2 from hemagglutinin__InfluenzaA__AEX35186
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99568 - RNA, 1698 nt, Artificial Sequence; identical to SEQ ID NO: 99567
  derived and/or modified sequence opt2 from hemagglutinin__InfluenzaA__AEX35197

SEQ ID NO: 99569 - RNA, 1698 nt, Artificial Sequence; identical to SEQ ID NO: 94000
  derived and/or modified sequence opt2 from hemagglutinin__InfluenzaA__AEX35208

SEQ ID NO: 99570 - RNA, 1701 nt, Artificial Sequence
  derived and/or modified sequence opt2 from hemagglutinin__InfluenzaA__AEX35219
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 99571 - RNA, 1698 nt, Artificial Sequence; identical to SEQ ID NO: 99512
  derived and/or modified sequence opt2 from hemagglutinin__InfluenzaA__AEX35230

SEQ ID NO: 99572 - RNA, 1701 nt, Artificial Sequence; identical to SEQ ID NO: 93409
  derived and/or modified sequence opt2 from hemagglutinin__InfluenzaA__AEX35241

SEQ ID NO: 99573 - RNA, 1698 nt, Artificial Sequence; identical to SEQ ID NO: 99512
  derived and/or modified sequence opt2 from hemagglutinin__InfluenzaA__AEX35263

SEQ ID NO: 99574 - RNA, 1698 nt, Artificial Sequence; identical to SEQ ID NO: 99512
  derived and/or modified sequence opt2 from hemagglutinin__InfluenzaA__AEX35274

SEQ ID NO: 99575 - RNA, 1701 nt, Artificial Sequence; identical to SEQ ID NO: 93307
  derived and/or modified sequence opt2 from hemagglutinin__InfluenzaA__AEX35285

SEQ ID NO: 99576 - RNA, 1701 nt, Artificial Sequence; identical to SEQ ID NO: 99473
  derived and/or modified sequence opt2 from hemagglutinin__InfluenzaA__AEX35296

SEQ ID NO: 99577 - RNA, 1701 nt, Artificial Sequence
  derived and/or modified sequence opt2 from hemagglutinin__InfluenzaA__AEX35307
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99578 - RNA, 1701 nt, Artificial Sequence; identical to SEQ ID NO: 99473
  derived and/or modified sequence opt2 from hemagglutinin__InfluenzaA__AEX35318

SEQ ID NO: 99579 - RNA, 1701 nt, Artificial Sequence
  derived and/or modified sequence opt2 from hemagglutinin__InfluenzaA__AEX35329
augaagaccaucaucgcccucuccuacuuccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99580 - RNA, 1701 nt, Artificial Sequence
  derived and/or modified sequence opt2 from hemagglutinin__InfluenzaA__AEX35340
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99581 - RNA, 1701 nt, Artificial Sequence; identical to SEQ ID NO: 99473
  derived and/or modified sequence opt2 from hemagglutinin__InfluenzaA__AEX35351

SEQ ID NO: 99582 - RNA, 1701 nt, Artificial Sequence; identical to SEQ ID NO: 99473
  derived and/or modified sequence opt2 from hemagglutinin__InfluenzaA__AEX35362

SEQ ID NO: 99583 - RNA, 1701 nt, Artificial Sequence; identical to SEQ ID NO: 93307
  derived and/or modified sequence opt2 from hemagglutinin__InfluenzaA__AEX35373

SEQ ID NO: 99584 - RNA, 1701 nt, Artificial Sequence
  derived and/or modified sequence opt2 from hemagglutinin__InfluenzaA__AEX35384
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucuccgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcacccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99585 - RNA, 1701 nt, Artificial Sequence
  derived and/or modified sequence opt2 from hemagglutinin__InfluenzaA__AEX35395
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaaguggaaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99586 - RNA, 1701 nt, Artificial Sequence; identical to SEQ ID NO: 93307
  derived and/or modified sequence opt2 from hemagglutinin__InfluenzaA__AEX35406

SEQ ID NO: 99587 - RNA, 1701 nt, Artificial Sequence; identical to SEQ ID NO: 93307
  derived and/or modified sequence opt2 from hemagglutinin__InfluenzaA__AEX35417

SEQ ID NO: 99588 - RNA, 1701 nt, Artificial Sequence
  derived and/or modified sequence opt2 from hemagglutinin__InfluenzaA__AEX35428
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccucuucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99589 - RNA, 1698 nt, Artificial Sequence
  derived and/or modified sequence opt2 from hemagglutinin__InfluenzaA__AEX35439
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 99590 - RNA, 1701 nt, Artificial Sequence
  derived and/or modified sequence opt2 from hemagglutinin__InfluenzaA__AEX35450
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99591 - RNA, 1701 nt, Artificial Sequence; identical to SEQ ID NO: 92142
  derived and/or modified sequence opt2 from hemagglutinin__InfluenzaA__AEX35461

SEQ ID NO: 99592 - RNA, 1701 nt, Artificial Sequence
  derived and/or modified sequence opt2 from hemagglutinin__InfluenzaA__AEX35472
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99593 - RNA, 1701 nt, Artificial Sequence; identical to SEQ ID NO: 92142
  derived and/or modified sequence opt2 from hemagglutinin__InfluenzaA__AEX35483

SEQ ID NO: 99594 - RNA, 1701 nt, Artificial Sequence
  derived and/or modified sequence opt2 from hemagglutinin__InfluenzaA__AEX35494
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99595 - RNA, 1701 nt, Artificial Sequence
  derived and/or modified sequence opt2 from hemagglutinin__InfluenzaA__AEX35505
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99596 - RNA, 1701 nt, Artificial Sequence
  derived and/or modified sequence opt2 from hemagglutinin__InfluenzaA__AEX35516
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99597 - RNA, 1701 nt, Artificial Sequence
  derived and/or modified sequence opt2 from hemagglutinin__InfluenzaA__AEX35527
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99598 - RNA, 1701 nt, Artificial Sequence
  derived and/or modified sequence opt2 from hemagglutinin__InfluenzaA__AEX35549
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgcggcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggcaagaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99599 - RNA, 1701 nt, Artificial Sequence
  derived and/or modified sequence opt2 from hemagglutinin__InfluenzaA__AEX35560
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgucggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99600 - RNA, 1701 nt, Artificial Sequence
  derived and/or modified sequence opt2 from hemagglutinin__InfluenzaA__AEX35571
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99601 - RNA, 1701 nt, Artificial Sequence; identical to SEQ ID NO: 92142
  derived and/or modified sequence opt2 from hemagglutinin__InfluenzaA__AEX35582

SEQ ID NO: 99602 - RNA, 1701 nt, Artificial Sequence
  derived and/or modified sequence opt2 from hemagglutinin__InfluenzaA__AEX35593
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccccccucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99603 - RNA, 1701 nt, Artificial Sequence; identical to SEQ ID NO: 93884
  derived and/or modified sequence opt2 from hemagglutinin__InfluenzaA__AEX35604

SEQ ID NO: 99604 - RNA, 1701 nt, Artificial Sequence
  derived and/or modified sequence opt2 from hemagglutinin__InfluenzaA__AEX35615
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacaucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99605 - RNA, 1701 nt, Artificial Sequence; identical to SEQ ID NO: 93946
  derived and/or modified sequence opt2 from hemagglutinin__InfluenzaA__AEX35626

SEQ ID NO: 99606 - RNA, 1701 nt, Artificial Sequence
  derived and/or modified sequence opt2 from hemagglutinin__InfluenzaA__AEX35637
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccgacaacuccuucuucuccaagcucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99607 - RNA, 1701 nt, Artificial Sequence; identical to SEQ ID NO: 93946
  derived and/or modified sequence opt2 from hemagglutinin__InfluenzaA__AEX35648

SEQ ID NO: 99608 - RNA, 1701 nt, Artificial Sequence
  derived and/or modified sequence opt2 from hemagglutinin__InfluenzaA__AEX36102
augaagaccaucaucgcccucuccuacauccucugccucgucuucgcccagaagcuccccggcaacaacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99609 - RNA, 1701 nt, Artificial Sequence; identical to SEQ ID NO: 93427
  derived and/or modified sequence opt2 from hemagglutinin__InfluenzaA__AEX36113

SEQ ID NO: 99610 - RNA, 1701 nt, Artificial Sequence; identical to SEQ ID NO: 93946
  derived and/or modified sequence opt2 from hemagglutinin__InfluenzaA__AEX36124

SEQ ID NO: 99611 - RNA, 1701 nt, Artificial Sequence
  derived and/or modified sequence opt2 from hemagglutinin__InfluenzaA__AEX36146
augaagaccaucaucgcccucuccuacauccucugccucguccucgcccagaagcuccccggcgacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99612 - RNA, 1701 nt, Artificial Sequence
  derived and/or modified sequence opt2 from hemagglutinin__InfluenzaA__AEX36168
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccgacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaacaagcucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 99613 - RNA, 1701 nt, Artificial Sequence; identical to SEQ ID NO: 93946
  derived and/or modified sequence opt2 from hemagglutinin__InfluenzaA__AEX36179

SEQ ID NO: 99614 - RNA, 1701 nt, Artificial Sequence; identical to SEQ ID NO: 99495
  derived and/or modified sequence opt2 from hemagglutinin__InfluenzaA__AEX36190

SEQ ID NO: 99615 - RNA, 1701 nt, Artificial Sequence; identical to SEQ ID NO: 99490
  derived and/or modified sequence opt2 from hemagglutinin__InfluenzaA__AEX36201

SEQ ID NO: 99616 - RNA, 1701 nt, Artificial Sequence
  derived and/or modified sequence opt2 from hemagglutinin__InfluenzaA__AEX36212
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagaucucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99617 - RNA, 1701 nt, Artificial Sequence; identical to SEQ ID NO: 99490
  derived and/or modified sequence opt2 from hemagglutinin__InfluenzaA__AEX36223

SEQ ID NO: 99618 - RNA, 1701 nt, Artificial Sequence
  derived and/or modified sequence opt2 from hemagglutinin__InfluenzaA__AEX36234
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccgacaacuccuucuucuccaagcucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugccucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99619 - RNA, 1701 nt, Artificial Sequence
  derived and/or modified sequence opt2 from hemagglutinin__InfluenzaA__AEX36245
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaagaccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99620 - RNA, 1701 nt, Artificial Sequence
  derived and/or modified sequence opt2 from hemagglutinin__InfluenzaA__AEX36256
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99621 - RNA, 1701 nt, Artificial Sequence; identical to SEQ ID NO: 99490
  derived and/or modified sequence opt2 from hemagglutinin__InfluenzaA__AEX36267

SEQ ID NO: 99622 - RNA, 1701 nt, Artificial Sequence
  derived and/or modified sequence opt2 from hemagglutinin__InfluenzaA__AEX36289
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagaucucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuaccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagcucggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99623 - RNA, 1701 nt, Artificial Sequence
  derived and/or modified sequence opt2 from hemagglutinin__InfluenzaA__AEX36300
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucuccaacgaguccuucaacuggaccggcgucacccagaacggcaccuccuccgccugcaagcgcggcuccaacaacuccuucuucuccaagcucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99624 - RNA, 1701 nt, Artificial Sequence
  derived and/or modified sequence opt2 from hemagglutinin__InfluenzaA__AEX36311
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99625 - RNA, 1701 nt, Artificial Sequence
  derived and/or modified sequence opt2 from hemagglutinin__InfluenzaA__AEX36322
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccccuacgcccaggccuccggccgcaucaccgucuccaccaagaucucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 99626 - RNA, 1701 nt, Artificial Sequence
  derived and/or modified sequence opt2 from hemagglutinin__InfluenzaA__AEX36333
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgccuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99627 - RNA, 1701 nt, Artificial Sequence
  derived and/or modified sequence opt2 from hemagglutinin__InfluenzaA__AEX36344
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaacgccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99628 - RNA, 1701 nt, Artificial Sequence
  derived and/or modified sequence opt2 from hemagglutinin__InfluenzaA__AEX36366
augaagaccaucaucgcccucuccuacauccucugccucgucuucgcccagaagcucuccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99629 - RNA, 1701 nt, Artificial Sequence; identical to SEQ ID NO: 93440
  derived and/or modified sequence opt2 from hemagglutinin__InfluenzaA__AEX36377

SEQ ID NO: 99630 - RNA, 1701 nt, Artificial Sequence
  derived and/or modified sequence opt2 from hemagglutinin__InfluenzaA__AEX36388
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99631 - RNA, 1701 nt, Artificial Sequence
  derived and/or modified sequence opt2 from hemagglutinin__InfluenzaA__AEX36399
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaccgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99632 - RNA, 1701 nt, Artificial Sequence
  derived and/or modified sequence opt2 from hemagglutinin__InfluenzaA__AEX36410
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99633 - RNA, 1701 nt, Artificial Sequence; identical to SEQ ID NO: 93946
  derived and/or modified sequence opt2 from hemagglutinin__InfluenzaA__AEX36421

SEQ ID NO: 99634 - RNA, 1701 nt, Artificial Sequence
  derived and/or modified sequence opt2 from hemagglutinin__InfluenzaA__AEX36432
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99635 - RNA, 1701 nt, Artificial Sequence
  derived and/or modified sequence opt2 from hemagglutinin__InfluenzaA__AEX36443
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99636 - RNA, 1701 nt, Artificial Sequence
  derived and/or modified sequence opt2 from hemagglutinin__InfluenzaA__AEX36454
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99637 - RNA, 1701 nt, Artificial Sequence; identical to SEQ ID NO: 93241
  derived and/or modified sequence opt2 from hemagglutinin__InfluenzaA__AEX36465

SEQ ID NO: 99638 - RNA, 1701 nt, Artificial Sequence
  derived and/or modified sequence opt2 from hemagglutinin__InfluenzaA__AEX36476
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcgacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99639 - RNA, 1701 nt, Artificial Sequence
  derived and/or modified sequence opt2 from hemagglutinin__InfluenzaA__AEX36487
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccuccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99640 - RNA, 1701 nt, Artificial Sequence; identical to SEQ ID NO: 99490
  derived and/or modified sequence opt2 from hemagglutinin__InfluenzaA__AEX36498

SEQ ID NO: 99641 - RNA, 1701 nt, Artificial Sequence
  derived and/or modified sequence opt2 from hemagglutinin__InfluenzaA__AEX36509
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99642 - RNA, 1701 nt, Artificial Sequence
  derived and/or modified sequence opt2 from hemagglutinin__InfluenzaA__AEX36520
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99643 - RNA, 1701 nt, Artificial Sequence
  derived and/or modified sequence opt2 from hemagglutinin__InfluenzaA__AEX36531
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgacaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99644 - RNA, 1701 nt, Artificial Sequence
  derived and/or modified sequence opt2 from hemagglutinin__InfluenzaA__AEX36542
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99645 - RNA, 1701 nt, Artificial Sequence; identical to SEQ ID NO: 99644
  derived and/or modified sequence opt2 from hemagglutinin__InfluenzaA__AEX36553

SEQ ID NO: 99646 - RNA, 1701 nt, Artificial Sequence; identical to SEQ ID NO: 99644
  derived and/or modified sequence opt2 from hemagglutinin__InfluenzaA__AEX36564

SEQ ID NO: 99647 - RNA, 1701 nt, Artificial Sequence
  derived and/or modified sequence opt2 from hemagglutinin__InfluenzaA__AEX36575
augaagaccaucaucgcccucuccuacauccucugccucgucuucgcccagaagcuccccggcaacggcaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgacaucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99648 - RNA, 1701 nt, Artificial Sequence
  derived and/or modified sequence opt2 from hemagglutinin__InfluenzaA__AEX36586
augaagaccaucaucgcccucuccuacauccucugccucgucuucgcccagaagcuccccggcaacgacaacaacaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99649 - RNA, 1701 nt, Artificial Sequence
  derived and/or modified sequence opt2 from hemagglutinin__InfluenzaA__AEX36597
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99650 - RNA, 1701 nt, Artificial Sequence
  derived and/or modified sequence opt2 from hemagglutinin__InfluenzaA__AEX36608
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaagcgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99651 - RNA, 1701 nt, Artificial Sequence; identical to SEQ ID NO: 99473
  derived and/or modified sequence opt2 from hemagglutinin__InfluenzaA__AEX36619

SEQ ID NO: 99652 - RNA, 1701 nt, Artificial Sequence
  derived and/or modified sequence opt2 from hemagglutinin__InfluenzaA__AEX63617
auggaggccaagcucuucguccucuucugcgccuucaccgcccucaaggccgacaccaucugcgucggcuaccacgccaacaacuccaccgacaccgucgacaccauccucgagaagaacgucaccgucacccacuccgucaaccuccucgagaacucccacaacggcaagcucugcucccucaacggcaagaucccccuccagcucggcaacugcaacgucgccggcuggauccucggcaaccccaagugcgaccuccuccucaccgccaacuccugguccuacaucaucgagaccuccaacuccaagaacggcgccugcuaccccggcgaguucgccgacuacgaggagcucaaggagcagcucuccaccgucuccuccuucgagcgcuucgagaucuuccccaaggccaccuccuggcccaaccacgacaccacccgcggcaccaccgucgccugcucccacuccggcgccaacuccuucuaccgcaaccuccucuggaucgucaagaagggcaacuccuaccccaagcucuccaaguccuacaccaacaacaagggcaaggagguccucgucaucuggggcguccaccacccccccaccgacuccguccagcagacccucuaccagaacaaccacaccuacgucuccgucggcuccuccaaguacuacaagcgcuucacccccgagaucgucgcccgccccaagguccgcgagcaggccggccgcaugaacuacuacuggacccuccucgaccagggcgacaccaucaccuucgaggccaccggcaaccucaucgcccccuggcacgccuucgcccucaagaagggcuccuccuccggcaucaugcgcuccgacgcccagguccacaacugcaccaccaagugccagaccccccacggcgcccucaagggcaaccuccccuuccagaacguccaccccgucaccaucggcgagugccccaaguacgucaaguccacccagcuccgcauggccaccggccuccgcaacauccccuccauccagucccgcggccucuucggcgccaucgccggcuucaucgagggcggcuggaccggcauggucgacggcugguacggcuaccaccaccgcaacgagcagggcuccggcuacgccgccgaccagaaguccacccagaucgccaucgacggcaucuccaacaaggucaacuccgucaucgagaagaugaacauccaguucaccuccgucggcaaggaguucaacucccucgagaagcgcauggagaaccucaacaagaaggucgacgacggcuuccucgacgucuggaccuacaacgccgagcuccucauccuccucgagaacgagcgcacccucgacuuccacgaccucaacgucaagaaccucuacgagaaggucaagucccagcuccgcaacaacgccaaggagaucggcaacggcugcuucgaguucuaccacaagugcgacaacgagugcauggaguccgucaagaacggcaccuacaacuaccucaaguacuccgaggaguccaagcucaaccgcgaggagaucgacggcgucaagcucgaguccaugggcauccaccagauccucgccaucuacuccaccgucgccuccucccucguccuccucgucucccucggcgccaucuccuucuggaugugcuccaacggcucccuccagugccgcgucugcaucuga

SEQ ID NO: 99653 - RNA, 1698 nt, Artificial Sequence; identical to SEQ ID NO: 94790
  derived and/or modified sequence opt2 from hemagglutinin__InfluenzaA__AEX92873

SEQ ID NO: 99654 - RNA, 1701 nt, Artificial Sequence; identical to SEQ ID NO: 95345
  derived and/or modified sequence opt2 from hemagglutinin__InfluenzaA__AEY69088

SEQ ID NO: 99655 - RNA, 1701 nt, Artificial Sequence; identical to SEQ ID NO: 94942
  derived and/or modified sequence opt2 from hemagglutinin__InfluenzaA__AEY69098

SEQ ID NO: 99656 - RNA, 1701 nt, Artificial Sequence; identical to SEQ ID NO: 94923
  derived and/or modified sequence opt2 from hemagglutinin__InfluenzaA__AEY69120

SEQ ID NO: 99657 - RNA, 1701 nt, Artificial Sequence; identical to SEQ ID NO: 95125
  derived and/or modified sequence opt2 from hemagglutinin__InfluenzaA__AEY69131

SEQ ID NO: 99658 - RNA, 1701 nt, Artificial Sequence; identical to SEQ ID NO: 98500
  derived and/or modified sequence opt2 from hemagglutinin__InfluenzaA__AEY69153

SEQ ID NO: 99659 - RNA, 1701 nt, Artificial Sequence; identical to SEQ ID NO: 95125
  derived and/or modified sequence opt2 from hemagglutinin__InfluenzaA__AEY69164

SEQ ID NO: 99660 - RNA, 1701 nt, Artificial Sequence; identical to SEQ ID NO: 95125
  derived and/or modified sequence opt2 from hemagglutinin__InfluenzaA__AEY69175

SEQ ID NO: 99661 - RNA, 1701 nt, Artificial Sequence; identical to SEQ ID NO: 95125
  derived and/or modified sequence opt2 from hemagglutinin__InfluenzaA__AEY69186

SEQ ID NO: 99662 - RNA, 1701 nt, Artificial Sequence; identical to SEQ ID NO: 95125
  derived and/or modified sequence opt2 from hemagglutinin__InfluenzaA__AEY69197

SEQ ID NO: 99663 - RNA, 1701 nt, Artificial Sequence; identical to SEQ ID NO: 95125
  derived and/or modified sequence opt2 from hemagglutinin__InfluenzaA__AEY69208

SEQ ID NO: 99664 - RNA, 1701 nt, Artificial Sequence; identical to SEQ ID NO: 95125
  derived and/or modified sequence opt2 from hemagglutinin__InfluenzaA__AEY69219

SEQ ID NO: 99665 - RNA, 1701 nt, Artificial Sequence; identical to SEQ ID NO: 94923
  derived and/or modified sequence opt2 from hemagglutinin__InfluenzaA__AEY69258

SEQ ID NO: 99666 - RNA, 1701 nt, Artificial Sequence; identical to SEQ ID NO: 95125
  derived and/or modified sequence opt2 from hemagglutinin__InfluenzaA__AEY69269

SEQ ID NO: 99667 - RNA, 1701 nt, Artificial Sequence; identical to SEQ ID NO: 94923
  derived and/or modified sequence opt2 from hemagglutinin__InfluenzaA__AEY69291

SEQ ID NO: 99668 - RNA, 1701 nt, Artificial Sequence; identical to SEQ ID NO: 94923
  derived and/or modified sequence opt2 from hemagglutinin__InfluenzaA__AEY69302

SEQ ID NO: 99669 - RNA, 1701 nt, Artificial Sequence; identical to SEQ ID NO: 94923
  derived and/or modified sequence opt2 from hemagglutinin__InfluenzaA__AEY69313

SEQ ID NO: 99670 - RNA, 1701 nt, Artificial Sequence; identical to SEQ ID NO: 94923
  derived and/or modified sequence opt2 from hemagglutinin__InfluenzaA__AEY69785

SEQ ID NO: 99671 - RNA, 1701 nt, Artificial Sequence
  derived and/or modified sequence opt2 from hemagglutinin__InfluenzaA__AEY69807
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagcuccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99672 - RNA, 1701 nt, Artificial Sequence; identical to SEQ ID NO: 95125
  derived and/or modified sequence opt2 from hemagglutinin__InfluenzaA__AEY69818

SEQ ID NO: 99673 - RNA, 1701 nt, Artificial Sequence; identical to SEQ ID NO: 95125
  derived and/or modified sequence opt2 from hemagglutinin__InfluenzaA__AEY69829

SEQ ID NO: 99674 - RNA, 1701 nt, Artificial Sequence; identical to SEQ ID NO: 95125
  derived and/or modified sequence opt2 from hemagglutinin__InfluenzaA__AEY69840

SEQ ID NO: 99675 - RNA, 1701 nt, Artificial Sequence; identical to SEQ ID NO: 95125
  derived and/or modified sequence opt2 from hemagglutinin__InfluenzaA__AEY69851

SEQ ID NO: 99676 - RNA, 1701 nt, Artificial Sequence; identical to SEQ ID NO: 95125
  derived and/or modified sequence opt2 from hemagglutinin__InfluenzaA__AEY69873

SEQ ID NO: 99677 - RNA, 1701 nt, Artificial Sequence; identical to SEQ ID NO: 95125
  derived and/or modified sequence opt2 from hemagglutinin__InfluenzaA__AEY69884

SEQ ID NO: 99678 - RNA, 1701 nt, Artificial Sequence; identical to SEQ ID NO: 95125
  derived and/or modified sequence opt2 from hemagglutinin__InfluenzaA__AEY69895

SEQ ID NO: 99679 - RNA, 1701 nt, Artificial Sequence; identical to SEQ ID NO: 98500
  derived and/or modified sequence opt2 from hemagglutinin__InfluenzaA__AEY69906

SEQ ID NO: 99680 - RNA, 1701 nt, Artificial Sequence; identical to SEQ ID NO: 95125
  derived and/or modified sequence opt2 from hemagglutinin__InfluenzaA__AEY69917

SEQ ID NO: 99681 - RNA, 1701 nt, Artificial Sequence
  derived and/or modified sequence opt2 from hemagglutinin__InfluenzaA__AEY69939
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgucugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacugguuccucuggaucuccuucgccaucuccugcuuccuccucugcgucgcccuccucggcuucaucaugugggccugccagaagggcaacauccgcugcaacaucugcaucuga

SEQ ID NO: 99682 - RNA, 1701 nt, Artificial Sequence; identical to SEQ ID NO: 99681
  derived and/or modified sequence opt2 from hemagglutinin__InfluenzaA__AEY69950

SEQ ID NO: 99683 - RNA, 1701 nt, Artificial Sequence; identical to SEQ ID NO: 99681
  derived and/or modified sequence opt2 from hemagglutinin__InfluenzaA__AEY69961

SEQ ID NO: 99684 - RNA, 1701 nt, Artificial Sequence
  derived and/or modified sequence opt2 from hemagglutinin__InfluenzaA__AEY69994
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacugguuccucuggaucuccuucgccaucuccugcuuccuccucugcgucgcccuccucggcuucaucaugugggccugccagaagggcaacauccgcugcaacaucugcaucuga

SEQ ID NO: 99685 - RNA, 1701 nt, Artificial Sequence; identical to SEQ ID NO: 99684
  derived and/or modified sequence opt2 from hemagglutinin__InfluenzaA__AEY70005

SEQ ID NO: 99686 - RNA, 1701 nt, Artificial Sequence; identical to SEQ ID NO: 95125
  derived and/or modified sequence opt2 from hemagglutinin__InfluenzaA__AEY70016

SEQ ID NO: 99687 - RNA, 1701 nt, Artificial Sequence
  derived and/or modified sequence opt2 from hemagglutinin__InfluenzaA__AEY70256
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacggcaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99688 - RNA, 1701 nt, Artificial Sequence; identical to SEQ ID NO: 95125
  derived and/or modified sequence opt2 from hemagglutinin__InfluenzaA__AEY70267

SEQ ID NO: 99689 - RNA, 1701 nt, Artificial Sequence; identical to SEQ ID NO: 95125
  derived and/or modified sequence opt2 from hemagglutinin__InfluenzaA__AEY70278

SEQ ID NO: 99690 - RNA, 1701 nt, Artificial Sequence; identical to SEQ ID NO: 94923
  derived and/or modified sequence opt2 from hemagglutinin__InfluenzaA__AEY70289

SEQ ID NO: 99691 - RNA, 1701 nt, Artificial Sequence; identical to SEQ ID NO: 95125
  derived and/or modified sequence opt2 from hemagglutinin__InfluenzaA__AEY70300

SEQ ID NO: 99692 - RNA, 1701 nt, Artificial Sequence; identical to SEQ ID NO: 95125
  derived and/or modified sequence opt2 from hemagglutinin__InfluenzaA__AEY70311

SEQ ID NO: 99693 - RNA, 1701 nt, Artificial Sequence; identical to SEQ ID NO: 95125
  derived and/or modified sequence opt2 from hemagglutinin__InfluenzaA__AEY70333

SEQ ID NO: 99694 - RNA, 1701 nt, Artificial Sequence; identical to SEQ ID NO: 99684
  derived and/or modified sequence opt2 from hemagglutinin__InfluenzaA__AEY70344

SEQ ID NO: 99695 - RNA, 1701 nt, Artificial Sequence; identical to SEQ ID NO: 96736
  derived and/or modified sequence opt2 from hemagglutinin__InfluenzaA__AEY70355

SEQ ID NO: 99696 - RNA, 1701 nt, Artificial Sequence; identical to SEQ ID NO: 94923
  derived and/or modified sequence opt2 from hemagglutinin__InfluenzaA__AEY70365

SEQ ID NO: 99697 - RNA, 1701 nt, Artificial Sequence; identical to SEQ ID NO: 95125
  derived and/or modified sequence opt2 from hemagglutinin__InfluenzaA__AEY70376

SEQ ID NO: 99698 - RNA, 1701 nt, Artificial Sequence
  derived and/or modified sequence opt2 from hemagglutinin__InfluenzaA__AFB18656
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 99699 - RNA, 1701 nt, Artificial Sequence; identical to SEQ ID NO: 98562
  derived and/or modified sequence opt2 from hemagglutinin__InfluenzaA__AFB40597

SEQ ID NO: 99700 - RNA, 1701 nt, Artificial Sequence; identical to SEQ ID NO: 98562
  derived and/or modified sequence opt2 from hemagglutinin__InfluenzaA__AFB40598

SEQ ID NO: 99701 - RNA, 1701 nt, Artificial Sequence
  derived and/or modified sequence opt2 from hemagglutinin__InfluenzaA__AFB40599
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99702 - RNA, 1701 nt, Artificial Sequence; identical to SEQ ID NO: 95345
  derived and/or modified sequence opt2 from hemagglutinin__InfluenzaA__AFB40600

SEQ ID NO: 99703 - RNA, 1701 nt, Artificial Sequence
  derived and/or modified sequence opt2 from hemagglutinin__InfluenzaA__AFB40601
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccgagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99704 - RNA, 1701 nt, Artificial Sequence; identical to SEQ ID NO: 94181
  derived and/or modified sequence opt2 from hemagglutinin__InfluenzaA__AFB40602

SEQ ID NO: 99705 - RNA, 1701 nt, Artificial Sequence; identical to SEQ ID NO: 95345
  derived and/or modified sequence opt2 from hemagglutinin__InfluenzaA__AFB40603

SEQ ID NO: 99706 - RNA, 1701 nt, Artificial Sequence
  derived and/or modified sequence opt2 from hemagglutinin__InfluenzaA__AFB40604
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccacccccccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucgacaaggaguucaaccaccucgagaagcgcaucggcaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99707 - RNA, 1701 nt, Artificial Sequence; identical to SEQ ID NO: 94181
  derived and/or modified sequence opt2 from hemagglutinin__InfluenzaA__AFB70138

SEQ ID NO: 99708 - RNA, 1701 nt, Artificial Sequence
  derived and/or modified sequence opt2 from hemagglutinin__InfluenzaA__AFB70145
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99709 - RNA, 1701 nt, Artificial Sequence
  derived and/or modified sequence opt2 from hemagglutinin__InfluenzaA__AFB70154
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99710 - RNA, 1701 nt, Artificial Sequence; identical to SEQ ID NO: 94181
  derived and/or modified sequence opt2 from hemagglutinin__InfluenzaA__AFB70156

SEQ ID NO: 99711 - RNA, 1701 nt, Artificial Sequence; identical to SEQ ID NO: 94181
  derived and/or modified sequence opt2 from hemagglutinin__InfluenzaA__AFB70158

SEQ ID NO: 99712 - RNA, 1701 nt, Artificial Sequence; identical to SEQ ID NO: 99708
  derived and/or modified sequence opt2 from hemagglutinin__InfluenzaA__AFB70160

SEQ ID NO: 99713 - RNA, 1701 nt, Artificial Sequence; identical to SEQ ID NO: 95375
  derived and/or modified sequence opt2 from hemagglutinin__InfluenzaA__AFB70162

SEQ ID NO: 99714 - RNA, 1701 nt, Artificial Sequence
  derived and/or modified sequence opt2 from hemagglutinin__InfluenzaA__AFB70167
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccaugcgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99715 - RNA, 1701 nt, Artificial Sequence; identical to SEQ ID NO: 94181
  derived and/or modified sequence opt2 from hemagglutinin__InfluenzaA__AFB70177

SEQ ID NO: 99716 - RNA, 1701 nt, Artificial Sequence; identical to SEQ ID NO: 94750
  derived and/or modified sequence opt2 from hemagglutinin__InfluenzaA__AFB70187

SEQ ID NO: 99717 - RNA, 1701 nt, Artificial Sequence; identical to SEQ ID NO: 95375
  derived and/or modified sequence opt2 from hemagglutinin__InfluenzaA__AFB70197

SEQ ID NO: 99718 - RNA, 1701 nt, Artificial Sequence; identical to SEQ ID NO: 94181
  derived and/or modified sequence opt2 from hemagglutinin__InfluenzaA__AFB70207

SEQ ID NO: 99719 - RNA, 1701 nt, Artificial Sequence; identical to SEQ ID NO: 94181
  derived and/or modified sequence opt2 from hemagglutinin__InfluenzaA__AFB70217

SEQ ID NO: 99720 - RNA, 1701 nt, Artificial Sequence; identical to SEQ ID NO: 94181
  derived and/or modified sequence opt2 from hemagglutinin__InfluenzaA__AFB70227

SEQ ID NO: 99721 - RNA, 1701 nt, Artificial Sequence
  derived and/or modified sequence opt2 from hemagglutinin__InfluenzaA__AFB70247
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaaggaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99722 - RNA, 1701 nt, Artificial Sequence
  derived and/or modified sequence opt2 from hemagglutinin__InfluenzaA__AFB70257
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucgucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99723 - RNA, 1701 nt, Artificial Sequence; identical to SEQ ID NO: 98588
  derived and/or modified sequence opt2 from hemagglutinin__InfluenzaA__AFB70267

SEQ ID NO: 99724 - RNA, 1701 nt, Artificial Sequence; identical to SEQ ID NO: 94651
  derived and/or modified sequence opt2 from hemagglutinin__InfluenzaA__AFB70277

SEQ ID NO: 99725 - RNA, 1701 nt, Artificial Sequence; identical to SEQ ID NO: 94181
  derived and/or modified sequence opt2 from hemagglutinin__InfluenzaA__AFB70287

SEQ ID NO: 99726 - RNA, 1701 nt, Artificial Sequence; identical to SEQ ID NO: 94181
  derived and/or modified sequence opt2 from hemagglutinin__InfluenzaA__AFB70297

SEQ ID NO: 99727 - RNA, 1701 nt, Artificial Sequence; identical to SEQ ID NO: 94181
  derived and/or modified sequence opt2 from hemagglutinin__InfluenzaA__AFB70307

SEQ ID NO: 99728 - RNA, 1701 nt, Artificial Sequence; identical to SEQ ID NO: 99708
  derived and/or modified sequence opt2 from hemagglutinin__InfluenzaA__AFB70317

SEQ ID NO: 99729 - RNA, 1701 nt, Artificial Sequence
  derived and/or modified sequence opt2 from hemagglutinin__InfluenzaA__AFB70327
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucggcaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99730 - RNA, 1701 nt, Artificial Sequence; identical to SEQ ID NO: 94181
  derived and/or modified sequence opt2 from hemagglutinin__InfluenzaA__AFB70337

SEQ ID NO: 99731 - RNA, 1701 nt, Artificial Sequence; identical to SEQ ID NO: 96151
  derived and/or modified sequence opt2 from hemagglutinin__InfluenzaA__AFB70347

SEQ ID NO: 99732 - RNA, 1701 nt, Artificial Sequence; identical to SEQ ID NO: 94181
  derived and/or modified sequence opt2 from hemagglutinin__InfluenzaA__AFB70367

SEQ ID NO: 99733 - RNA, 1701 nt, Artificial Sequence; identical to SEQ ID NO: 94181
  derived and/or modified sequence opt2 from hemagglutinin__InfluenzaA__AFB70377

SEQ ID NO: 99734 - RNA, 1701 nt, Artificial Sequence; identical to SEQ ID NO: 94750
  derived and/or modified sequence opt2 from hemagglutinin__InfluenzaA__AFB70387

SEQ ID NO: 99735 - RNA, 1701 nt, Artificial Sequence; identical to SEQ ID NO: 94181
  derived and/or modified sequence opt2 from hemagglutinin__InfluenzaA__AFB70397

SEQ ID NO: 99736 - RNA, 1701 nt, Artificial Sequence; identical to SEQ ID NO: 94181
  derived and/or modified sequence opt2 from hemagglutinin__InfluenzaA__AFB70407

SEQ ID NO: 99737 - RNA, 1701 nt, Artificial Sequence
  derived and/or modified sequence opt2 from hemagglutinin__InfluenzaA__AFB77618
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccaccaccaccggcgaccagcagucccucuaccagaacgccgacggcuacgucuucgucggcaccacccgcuacuccaagaaguucaagcccgagaucggcauccgccccaaggucaaggaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucgucauggucgucucccucggcgccaucuccuucuggaugugcuccaacggcucccuccagugccgcaucugcaucuga

SEQ ID NO: 99738 - RNA, 1701 nt, Artificial Sequence; identical to SEQ ID NO: 98379
  derived and/or modified sequence opt2 from hemagglutinin__InfluenzaA__AFB77619

SEQ ID NO: 99739 - RNA, 1701 nt, Artificial Sequence; identical to SEQ ID NO: 98379
  derived and/or modified sequence opt2 from hemagglutinin__InfluenzaA__AFB77620

SEQ ID NO: 99740 - RNA, 1701 nt, Artificial Sequence
  derived and/or modified sequence opt2 from hemagglutinin__InfluenzaA__AFB77621
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99741 - RNA, 1701 nt, Artificial Sequence
  derived and/or modified sequence opt2 from hemagglutinin__InfluenzaA__AFB77622
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99742 - RNA, 1701 nt, Artificial Sequence; identical to SEQ ID NO: 98379
  derived and/or modified sequence opt2 from hemagglutinin__InfluenzaA__AFB77623

SEQ ID NO: 99743 - RNA, 1701 nt, Artificial Sequence; identical to SEQ ID NO: 98379
  derived and/or modified sequence opt2 from hemagglutinin__InfluenzaA__AFB77624

SEQ ID NO: 99744 - RNA, 1701 nt, Artificial Sequence
  derived and/or modified sequence opt2 from hemagglutinin__InfluenzaA__AFB77625
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99745 - RNA, 1701 nt, Artificial Sequence
  derived and/or modified sequence opt2 from hemagglutinin__InfluenzaA__AFB77627
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuucuccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99746 - RNA, 1701 nt, Artificial Sequence; identical to SEQ ID NO: 98379
  derived and/or modified sequence opt2 from hemagglutinin__InfluenzaA__AFB77628

SEQ ID NO: 99747 - RNA, 1701 nt, Artificial Sequence
  derived and/or modified sequence opt2 from hemagglutinin__InfluenzaA__AFB77629
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgaggagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99748 - RNA, 1701 nt, Artificial Sequence
  derived and/or modified sequence opt2 from hemagglutinin__InfluenzaA__AFB77630
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99749 - RNA, 1701 nt, Artificial Sequence
  derived and/or modified sequence opt2 from hemagglutinin__InfluenzaA__AFB77631
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99750 - RNA, 1701 nt, Artificial Sequence
  derived and/or modified sequence opt2 from hemagglutinin__InfluenzaA__AFB77632
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucaccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugcaagaucugcaucuga

SEQ ID NO: 99751 - RNA, 1701 nt, Artificial Sequence
  derived and/or modified sequence opt2 from hemagglutinin__InfluenzaA__AFB77633
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagaaccagcucaagaacaacgccaaggagaucggcaacggcugcuucgaguucuaccacaagugcgacaacacccccaucaagaacgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99752 - RNA, 1701 nt, Artificial Sequence
  derived and/or modified sequence opt2 from hemagglutinin__InfluenzaA__AFB77634
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgagaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99753 - RNA, 1701 nt, Artificial Sequence
  derived and/or modified sequence opt2 from hemagglutinin__InfluenzaA__AFB77635
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccucccccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99754 - RNA, 1701 nt, Artificial Sequence
  derived and/or modified sequence opt2 from hemagglutinin__InfluenzaA__AFB77636
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaaggccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucgucauggucgucucccucggcgccaucuccuucuggaugugcuccaacggcucccuccagugccgcaucugcaucuga

SEQ ID NO: 99755 - RNA, 1701 nt, Artificial Sequence
  derived and/or modified sequence opt2 from hemagglutinin__InfluenzaA__AFB77637
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagggccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99756 - RNA, 1701 nt, Artificial Sequence
  derived and/or modified sequence opt2 from hemagglutinin__InfluenzaA__AFB77638
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguucuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99757 - RNA, 1701 nt, Artificial Sequence; identical to SEQ ID NO: 98379
  derived and/or modified sequence opt2 from hemagglutinin__InfluenzaA__AFB77639

SEQ ID NO: 99758 - RNA, 1701 nt, Artificial Sequence
  derived and/or modified sequence opt2 from hemagglutinin__InfluenzaA__AFB77640
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99759 - RNA, 1701 nt, Artificial Sequence
  derived and/or modified sequence opt2 from hemagglutinin__InfluenzaA__AFB77641
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99760 - RNA, 1701 nt, Artificial Sequence; identical to SEQ ID NO: 98379
  derived and/or modified sequence opt2 from hemagglutinin__InfluenzaA__AFB77642

SEQ ID NO: 99761 - RNA, 1701 nt, Artificial Sequence
  derived and/or modified sequence opt2 from hemagglutinin__InfluenzaA__AFB77643
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagcccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacgacaccaaggacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99762 - RNA, 1701 nt, Artificial Sequence
  derived and/or modified sequence opt2 from hemagglutinin__InfluenzaA__AFB77691
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgagaagcucuacaucuggggcguccaccaccccggcaccgacaaggaccagaucuuccucuacgcccaggccuccggccgcaucaccgucuccaccaagcgcucccagcaggccgucauccccaacaucggcucccgccuccgcguccgcaacauccccucccgcaucuccaucuacuggaccaucgucaagcccggcgacauccuccucaucaacuccaccggcaaccucaacgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaaccagcuccgcgagaacgccgaggacaugggcaacggcugcuucaagaucuaccacaagugcgacaacaccugcaucggcuccauccgcaacggcaccuacgaccacgacgccuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99763 - RNA, 1701 nt, Artificial Sequence
  derived and/or modified sequence opt2 from hemagglutinin__InfluenzaA__AFB77692
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaccggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99764 - RNA, 1701 nt, Artificial Sequence; identical to SEQ ID NO: 99294
  derived and/or modified sequence opt2 from hemagglutinin__InfluenzaA__AFB77693

SEQ ID NO: 99765 - RNA, 1701 nt, Artificial Sequence
  derived and/or modified sequence opt2 from hemagglutinin__InfluenzaA__AFB77694
augaagaccaucaucgcccucuccuacauccucugccucgucuucgcccagaagcuccccggcaacgacaacuccaccgccacccucugccucggccaccacgccguccccaacggcaccaucgucaagaccaucgccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99766 - RNA, 1701 nt, Artificial Sequence
  derived and/or modified sequence opt2 from hemagglutinin__InfluenzaA__AFB77695
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99767 - RNA, 1701 nt, Artificial Sequence
  derived and/or modified sequence opt2 from hemagglutinin__InfluenzaA__AFB78126
augaagaccaucaucgcccucuccuacauccucugccucgucuucgcccagaagcuccccggcaacgacaacuccaccgccacccucugccucggccaccacgccgucuccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccaggacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucuccaucuacgcccaggccuccggccgcgucaccgucuccaccaagcgcucccagcagaccgucauccccaacaucggcuccucccccuggguccgcggcgccuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaccaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99768 - RNA, 1701 nt, Artificial Sequence
  derived and/or modified sequence opt2 from hemagglutinin__InfluenzaA__AFC34056
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagcgcacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99769 - RNA, 1701 nt, Artificial Sequence; identical to SEQ ID NO: 99768
  derived and/or modified sequence opt2 from hemagglutinin__InfluenzaA__AFC34057

SEQ ID NO: 99770 - RNA, 1701 nt, Artificial Sequence
  derived and/or modified sequence opt2 from hemagglutinin__InfluenzaA__AFD32426
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugcaagcuccgcggcgucgccccccuccaccucggcaagugcaacaucgccggccgcauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaagugccagaccccccucggcgccaucaacuccucccuccccuaccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 99771 - RNA, 1698 nt, Artificial Sequence
  derived and/or modified sequence opt2 from hemagglutinin__InfluenzaA__AFD32427
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagaccccccucggcgccaucaacuccucccuccccuaccagaacauccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 99772 - RNA, 1722 nt, Artificial Sequence
  derived and/or modified sequence opt2 from hemagglutinin__InfluenzaA__AFD32428
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99773 - RNA, 1704 nt, Artificial Sequence
  derived and/or modified sequence opt2 from hemagglutinin__InfluenzaA__AFD32429
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcacccagggcaagcgccccaccgaccucggccagugcggccuccucggcacccucaucggccccccccagugcgaccaguuccucgaguucgacgccgaccucaucaucgagcgccgcgagggcaccgacgucugcuaccccggcaaguucaccaacgaggagucccuccgccagauccuccgcggcuccggcggcaucgacaaggaguccaugggcuucaccuacuccggcauccgcaccaacggcgccaccuccgccugccgccgcuccggcuccuccuucuacgccgagaugaaguggcuccucuccaacuccgacaacgccgaguucccccagaugaccaaguccuaccgcaacccccgcaacaagcccgcccucaucaucuggggcguccaccacuccggcuccgccaccgagcagaccaagcucuacggcuccggcaacaagcucaucaccgucggcuccuccaaguaccagcaguccuucacccccucccccggcgcccgcccccaggucaacggccaguccggccgcaucgacuuccacuggcuccuccucgaccccaacgacaccgucaccuucaccuucaacggcgccuucaucgcccccgaccgcgccuccuucuuccgcggcgagucccucggcguccaguccgacgucccccucgacuccggcugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99774 - RNA, 1701 nt, Artificial Sequence; identical to SEQ ID NO: 91585
  derived and/or modified sequence opt2 from hemagglutinin__InfluenzaA__AFD63527

SEQ ID NO: 99775 - RNA, 1701 nt, Artificial Sequence
  derived and/or modified sequence opt2 from hemagglutinin__InfluenzaA__AFD63538
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcuccaucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuaccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99776 - RNA, 1701 nt, Artificial Sequence
  derived and/or modified sequence opt2 from hemagglutinin__InfluenzaA__AFD63549
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99777 - RNA, 1701 nt, Artificial Sequence; identical to SEQ ID NO: 91585
  derived and/or modified sequence opt2 from hemagglutinin__InfluenzaA__AFD63571

SEQ ID NO: 99778 - RNA, 1701 nt, Artificial Sequence
  derived and/or modified sequence opt2 from hemagglutinin__InfluenzaA__AFD63615
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgaggagcgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99779 - RNA, 1701 nt, Artificial Sequence
  derived and/or modified sequence opt2 from hemagglutinin__InfluenzaA__AFD63626
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99780 - RNA, 1701 nt, Artificial Sequence
  derived and/or modified sequence opt2 from hemagglutinin__InfluenzaA__AFD63637
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccaccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99781 - RNA, 1701 nt, Artificial Sequence
  derived and/or modified sequence opt2 from hemagglutinin__InfluenzaA__AFD63648
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99782 - RNA, 1701 nt, Artificial Sequence; identical to SEQ ID NO: 91585
  derived and/or modified sequence opt2 from hemagglutinin__InfluenzaA__AFD63659

SEQ ID NO: 99783 - RNA, 1701 nt, Artificial Sequence
  derived and/or modified sequence opt2 from hemagglutinin__InfluenzaA__AFD63681
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagguccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99784 - RNA, 1701 nt, Artificial Sequence
  derived and/or modified sequence opt2 from hemagglutinin__InfluenzaA__AFD63692
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccuccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99785 - RNA, 1701 nt, Artificial Sequence
  derived and/or modified sequence opt2 from hemagglutinin__InfluenzaA__AFD63703
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccuccggcaucugcgacucccccuaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99786 - RNA, 1701 nt, Artificial Sequence
  derived and/or modified sequence opt2 from hemagglutinin__InfluenzaA__AFD63714
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccaccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcagaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99787 - RNA, 1701 nt, Artificial Sequence
  derived and/or modified sequence opt2 from hemagglutinin__InfluenzaA__AFD63736
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccaccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99788 - RNA, 1701 nt, Artificial Sequence
  derived and/or modified sequence opt2 from hemagglutinin__InfluenzaA__AFD63747
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccgcaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99789 - RNA, 1701 nt, Artificial Sequence
  derived and/or modified sequence opt2 from hemagglutinin__InfluenzaA__AFD63758
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99790 - RNA, 1701 nt, Artificial Sequence
  derived and/or modified sequence opt2 from hemagglutinin__InfluenzaA__AFD63769
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaaguccgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99791 - RNA, 1701 nt, Artificial Sequence; identical to SEQ ID NO: 91585
  derived and/or modified sequence opt2 from hemagglutinin__InfluenzaA__AFD63780

SEQ ID NO: 99792 - RNA, 1701 nt, Artificial Sequence; identical to SEQ ID NO: 99789
  derived and/or modified sequence opt2 from hemagglutinin__InfluenzaA__AFD63791

SEQ ID NO: 99793 - RNA, 1701 nt, Artificial Sequence; identical to SEQ ID NO: 91585
  derived and/or modified sequence opt2 from hemagglutinin__InfluenzaA__AFD63802

SEQ ID NO: 99794 - RNA, 1701 nt, Artificial Sequence
  derived and/or modified sequence opt2 from hemagglutinin__InfluenzaA__AFD63813
augaagaccaucaucgcccucuccuacauccucucccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcucccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 99795 - RNA, 1701 nt, Artificial Sequence; identical to SEQ ID NO: 99779
  derived and/or modified sequence opt2 from hemagglutinin__InfluenzaA__AFD63824

SEQ ID NO: 99796 - RNA, 1701 nt, Artificial Sequence; identical to SEQ ID NO: 91585
  derived and/or modified sequence opt2 from hemagglutinin__InfluenzaA__AFD63846

SEQ ID NO: 99797 - RNA, 1701 nt, Artificial Sequence; identical to SEQ ID NO: 92823
  derived and/or modified sequence opt2 from hemagglutinin__InfluenzaA__AFD63857

SEQ ID NO: 99798 - RNA, 1701 nt, Artificial Sequence; identical to SEQ ID NO: 91585
  derived and/or modified sequence opt2 from hemagglutinin__InfluenzaA__AFD63868

SEQ ID NO: 99799 - RNA, 1701 nt, Artificial Sequence; identical to SEQ ID NO: 91585
  derived and/or modified sequence opt2 from hemagglutinin__InfluenzaA__AFD63890

SEQ ID NO: 99800 - RNA, 1701 nt, Artificial Sequence; identical to SEQ ID NO: 91585
  derived and/or modified sequence opt2 from hemagglutinin__InfluenzaA__AFD63901

SEQ ID NO: 99801 - RNA, 1701 nt, Artificial Sequence; identical to SEQ ID NO: 91585
  derived and/or modified sequence opt2 from hemagglutinin__InfluenzaA__AFD63912

SEQ ID NO: 99802 - RNA, 1701 nt, Artificial Sequence
  derived and/or modified sequence opt2 from hemagglutinin__InfluenzaA__AFD63923
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99803 - RNA, 1701 nt, Artificial Sequence
  derived and/or modified sequence opt2 from hemagglutinin__InfluenzaA__AFD63934
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgaguccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccgucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99804 - RNA, 1701 nt, Artificial Sequence; identical to SEQ ID NO: 99779
  derived and/or modified sequence opt2 from hemagglutinin__InfluenzaA__AFD63945

SEQ ID NO: 99805 - RNA, 1701 nt, Artificial Sequence; identical to SEQ ID NO: 99779
  derived and/or modified sequence opt2 from hemagglutinin__InfluenzaA__AFD63956

SEQ ID NO: 99806 - RNA, 1701 nt, Artificial Sequence; identical to SEQ ID NO: 99779
  derived and/or modified sequence opt2 from hemagglutinin__InfluenzaA__AFD63967

SEQ ID NO: 99807 - RNA, 1701 nt, Artificial Sequence; identical to SEQ ID NO: 91585
  derived and/or modified sequence opt2 from hemagglutinin__InfluenzaA__AFD63989

SEQ ID NO: 99808 - RNA, 1701 nt, Artificial Sequence; identical to SEQ ID NO: 91585
  derived and/or modified sequence opt2 from hemagglutinin__InfluenzaA__AFD64000

SEQ ID NO: 99809 - RNA, 1701 nt, Artificial Sequence
  derived and/or modified sequence opt2 from hemagglutinin__InfluenzaA__AFD64011
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggcccccggcaagaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 99810 - RNA, 1701 nt, Artificial Sequence; identical to SEQ ID NO: 91585
  derived and/or modified sequence opt2 from hemagglutinin__InfluenzaA__AFD64022

SEQ ID NO: 99811 - RNA, 1701 nt, Artificial Sequence; identical to SEQ ID NO: 91585
  derived and/or modified sequence opt2 from hemagglutinin__InfluenzaA__AFD64033

SEQ ID NO: 99812 - RNA, 1701 nt, Artificial Sequence
  derived and/or modified sequence opt2 from hemagglutinin__InfluenzaA__AFD64044
augaagaccaucaucgcccucuccuacauccucugccucgucuucgcccagaagcuccccggcaacgagaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99813 - RNA, 1701 nt, Artificial Sequence; identical to SEQ ID NO: 99789
  derived and/or modified sequence opt2 from hemagglutinin__InfluenzaA__AFD64055

SEQ ID NO: 99814 - RNA, 1701 nt, Artificial Sequence
  derived and/or modified sequence opt2 from hemagglutinin__InfluenzaA__AFD64066
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacaccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacgccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 99815 - RNA, 1701 nt, Artificial Sequence
  derived and/or modified sequence opt2 from hemagglutinin__InfluenzaA__AFD64077
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcauccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99816 - RNA, 1701 nt, Artificial Sequence; identical to SEQ ID NO: 91585
  derived and/or modified sequence opt2 from hemagglutinin__InfluenzaA__AFD64088

SEQ ID NO: 99817 - RNA, 1701 nt, Artificial Sequence; identical to SEQ ID NO: 91585
  derived and/or modified sequence opt2 from hemagglutinin__InfluenzaA__AFD64099

SEQ ID NO: 99818 - RNA, 1701 nt, Artificial Sequence; identical to SEQ ID NO: 99789
  derived and/or modified sequence opt2 from hemagglutinin__InfluenzaA__AFD64110

SEQ ID NO: 99819 - RNA, 1701 nt, Artificial Sequence
  derived and/or modified sequence opt2 from hemagglutinin__InfluenzaA__AFD64121
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99820 - RNA, 1701 nt, Artificial Sequence; identical to SEQ ID NO: 91585
  derived and/or modified sequence opt2 from hemagglutinin__InfluenzaA__AFD64132

SEQ ID NO: 99821 - RNA, 1701 nt, Artificial Sequence; identical to SEQ ID NO: 99779
  derived and/or modified sequence opt2 from hemagglutinin__InfluenzaA__AFD64143

SEQ ID NO: 99822 - RNA, 1701 nt, Artificial Sequence; identical to SEQ ID NO: 91585
  derived and/or modified sequence opt2 from hemagglutinin__InfluenzaA__AFD64154

SEQ ID NO: 99823 - RNA, 1701 nt, Artificial Sequence
  derived and/or modified sequence opt2 from hemagglutinin__InfluenzaA__AFD64179
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99824 - RNA, 1701 nt, Artificial Sequence; identical to SEQ ID NO: 99823
  derived and/or modified sequence opt2 from hemagglutinin__InfluenzaA__AFD64190

SEQ ID NO: 99825 - RNA, 1701 nt, Artificial Sequence; identical to SEQ ID NO: 99779
  derived and/or modified sequence opt2 from hemagglutinin__InfluenzaA__AFD64201

SEQ ID NO: 99826 - RNA, 1701 nt, Artificial Sequence; identical to SEQ ID NO: 99789
  derived and/or modified sequence opt2 from hemagglutinin__InfluenzaA__AFD64212

SEQ ID NO: 99827 - RNA, 1701 nt, Artificial Sequence
  derived and/or modified sequence opt2 from hemagglutinin__InfluenzaA__AFD64223
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccuccaccccggcaccgacuccgaccagauccgccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccaguacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99828 - RNA, 1701 nt, Artificial Sequence
  derived and/or modified sequence opt2 from hemagglutinin__InfluenzaA__AFD64315
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaaccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99829 - RNA, 1701 nt, Artificial Sequence; identical to SEQ ID NO: 99819
  derived and/or modified sequence opt2 from hemagglutinin__InfluenzaA__AFD64326

SEQ ID NO: 99830 - RNA, 1701 nt, Artificial Sequence; identical to SEQ ID NO: 99789
  derived and/or modified sequence opt2 from hemagglutinin__InfluenzaA__AFD64337

SEQ ID NO: 99831 - RNA, 1701 nt, Artificial Sequence; identical to SEQ ID NO: 91585
  derived and/or modified sequence opt2 from hemagglutinin__InfluenzaA__AFD64348

SEQ ID NO: 99832 - RNA, 1701 nt, Artificial Sequence; identical to SEQ ID NO: 99789
  derived and/or modified sequence opt2 from hemagglutinin__InfluenzaA__AFD64359

SEQ ID NO: 99833 - RNA, 1701 nt, Artificial Sequence
  derived and/or modified sequence opt2 from hemagglutinin__InfluenzaA__AFD64370
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99834 - RNA, 1701 nt, Artificial Sequence; identical to SEQ ID NO: 91585
  derived and/or modified sequence opt2 from hemagglutinin__InfluenzaA__AFD64381

SEQ ID NO: 99835 - RNA, 1701 nt, Artificial Sequence; identical to SEQ ID NO: 99789
  derived and/or modified sequence opt2 from hemagglutinin__InfluenzaA__AFD64392

SEQ ID NO: 99836 - RNA, 1701 nt, Artificial Sequence; identical to SEQ ID NO: 99779
  derived and/or modified sequence opt2 from hemagglutinin__InfluenzaA__AFD64403

SEQ ID NO: 99837 - RNA, 1701 nt, Artificial Sequence; identical to SEQ ID NO: 99779
  derived and/or modified sequence opt2 from hemagglutinin__InfluenzaA__AFD64414

SEQ ID NO: 99838 - RNA, 1701 nt, Artificial Sequence
  derived and/or modified sequence opt2 from hemagglutinin__InfluenzaA__AFD64425
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccaacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99839 - RNA, 1701 nt, Artificial Sequence; identical to SEQ ID NO: 91585
  derived and/or modified sequence opt2 from hemagglutinin__InfluenzaA__AFD64436

SEQ ID NO: 99840 - RNA, 1701 nt, Artificial Sequence; identical to SEQ ID NO: 91585
  derived and/or modified sequence opt2 from hemagglutinin__InfluenzaA__AFD64447

SEQ ID NO: 99841 - RNA, 1701 nt, Artificial Sequence
  derived and/or modified sequence opt2 from hemagglutinin__InfluenzaA__AFD64458
augaagaccaucaucgcccucuccuacauccucugccucgucuucgcccagaagcuccccggcaacgacaacuccaccgccacccucugccucggccaccacgccguccagaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99842 - RNA, 1701 nt, Artificial Sequence; identical to SEQ ID NO: 98367
  derived and/or modified sequence opt2 from hemagglutinin__InfluenzaA__AFD64795

SEQ ID NO: 99843 - RNA, 1701 nt, Artificial Sequence; identical to SEQ ID NO: 98494
  derived and/or modified sequence opt2 from hemagglutinin__InfluenzaA__AFD64799

SEQ ID NO: 99844 - RNA, 1701 nt, Artificial Sequence
  derived and/or modified sequence opt2 from hemagglutinin__InfluenzaA__AFD64802
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccgaguacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99845 - RNA, 1701 nt, Artificial Sequence
  derived and/or modified sequence opt2 from hemagglutinin__InfluenzaA__AFD64804
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99846 - RNA, 1701 nt, Artificial Sequence
  derived and/or modified sequence opt2 from hemagglutinin__InfluenzaA__AFD64806
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99847 - RNA, 1701 nt, Artificial Sequence
  derived and/or modified sequence opt2 from hemagglutinin__InfluenzaA__AFD64807
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcgacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgccccccucggcaagugccacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacauguaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99848 - RNA, 1701 nt, Artificial Sequence
  derived and/or modified sequence opt2 from hemagglutinin__InfluenzaA__AFD64810
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccccgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99849 - RNA, 1701 nt, Artificial Sequence
  derived and/or modified sequence opt2 from hemagglutinin__InfluenzaA__AFD64812
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaccgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99850 - RNA, 1701 nt, Artificial Sequence
  derived and/or modified sequence opt2 from hemagglutinin__InfluenzaA__AFD64814
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccccgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99851 - RNA, 1701 nt, Artificial Sequence
  derived and/or modified sequence opt2 from hemagglutinin__InfluenzaA__AFD64816
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99852 - RNA, 1701 nt, Artificial Sequence
  derived and/or modified sequence opt2 from hemagglutinin__InfluenzaA__AFD64818
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgccccccucggcaagugcaucuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99853 - RNA, 1701 nt, Artificial Sequence
  derived and/or modified sequence opt2 from hemagglutinin__InfluenzaA__AFD64819
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcauccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaucuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccccgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99854 - RNA, 1701 nt, Artificial Sequence; identical to SEQ ID NO: 98494
  derived and/or modified sequence opt2 from hemagglutinin__InfluenzaA__AFD64820

SEQ ID NO: 99855 - RNA, 1701 nt, Artificial Sequence
  derived and/or modified sequence opt2 from hemagglutinin__InfluenzaA__AFD64822
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99856 - RNA, 1701 nt, Artificial Sequence
  derived and/or modified sequence opt2 from hemagglutinin__InfluenzaA__AFD64823
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggccgcugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99857 - RNA, 1701 nt, Artificial Sequence
  derived and/or modified sequence opt2 from hemagglutinin__InfluenzaA__AFD64824
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 99858 - RNA, 1701 nt, Artificial Sequence; identical to SEQ ID NO: 99846
  derived and/or modified sequence opt2 from hemagglutinin__InfluenzaA__AFD64825

SEQ ID NO: 99859 - RNA, 1701 nt, Artificial Sequence; identical to SEQ ID NO: 99846
  derived and/or modified sequence opt2 from hemagglutinin__InfluenzaA__AFD64827

SEQ ID NO: 99860 - RNA, 1701 nt, Artificial Sequence
  derived and/or modified sequence opt2 from hemagglutinin__InfluenzaA__AFD64828
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccccgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99861 - RNA, 1701 nt, Artificial Sequence; identical to SEQ ID NO: 99855
  derived and/or modified sequence opt2 from hemagglutinin__InfluenzaA__AFD64830

SEQ ID NO: 99862 - RNA, 1701 nt, Artificial Sequence; identical to SEQ ID NO: 98494
  derived and/or modified sequence opt2 from hemagglutinin__InfluenzaA__AFD98095

SEQ ID NO: 99863 - RNA, 1701 nt, Artificial Sequence
  derived and/or modified sequence opt2 from hemagglutinin__InfluenzaA__AFD98106
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99864 - RNA, 1701 nt, Artificial Sequence
  derived and/or modified sequence opt2 from hemagglutinin__InfluenzaA__AFD98128
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99865 - RNA, 1701 nt, Artificial Sequence; identical to SEQ ID NO: 98494
  derived and/or modified sequence opt2 from hemagglutinin__InfluenzaA__AFD98139

SEQ ID NO: 99866 - RNA, 1701 nt, Artificial Sequence
  derived and/or modified sequence opt2 from hemagglutinin__InfluenzaA__AFD98161
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99867 - RNA, 1701 nt, Artificial Sequence
  derived and/or modified sequence opt2 from hemagglutinin__InfluenzaA__AFD98172
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcgucgcccuccucggcuucaucaugugggccugccagaagggcaacauccgcugcaacaucugcaucuga

SEQ ID NO: 99868 - RNA, 1701 nt, Artificial Sequence
  derived and/or modified sequence opt2 from hemagglutinin__InfluenzaA__AFD98183
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccguccuccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99869 - RNA, 1701 nt, Artificial Sequence; identical to SEQ ID NO: 98367
  derived and/or modified sequence opt2 from hemagglutinin__InfluenzaA__AFD98194

SEQ ID NO: 99870 - RNA, 1701 nt, Artificial Sequence; identical to SEQ ID NO: 98421
  derived and/or modified sequence opt2 from hemagglutinin__InfluenzaA__AFD98205

SEQ ID NO: 99871 - RNA, 1701 nt, Artificial Sequence; identical to SEQ ID NO: 99863
  derived and/or modified sequence opt2 from hemagglutinin__InfluenzaA__AFD98215

SEQ ID NO: 99872 - RNA, 1701 nt, Artificial Sequence; identical to SEQ ID NO: 98494
  derived and/or modified sequence opt2 from hemagglutinin__InfluenzaA__AFD98226

SEQ ID NO: 99873 - RNA, 1701 nt, Artificial Sequence
  derived and/or modified sequence opt2 from hemagglutinin__InfluenzaA__AFD98237
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99874 - RNA, 1701 nt, Artificial Sequence; identical to SEQ ID NO: 99866
  derived and/or modified sequence opt2 from hemagglutinin__InfluenzaA__AFD98248

SEQ ID NO: 99875 - RNA, 1701 nt, Artificial Sequence
  derived and/or modified sequence opt2 from hemagglutinin__InfluenzaA__AFD98259
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcuccaaggccuacuccaacugcuaccccuacgacguccaggacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99876 - RNA, 1701 nt, Artificial Sequence
  derived and/or modified sequence opt2 from hemagglutinin__InfluenzaA__AFD98270
augaaggccauccucgucguccuccucuacaccuucgucaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99877 - RNA, 1701 nt, Artificial Sequence
  derived and/or modified sequence opt2 from hemagglutinin__InfluenzaA__AFD98280
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgacucccucuccaccgcccgcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99878 - RNA, 1701 nt, Artificial Sequence; identical to SEQ ID NO: 99855
  derived and/or modified sequence opt2 from hemagglutinin__InfluenzaA__AFD98290

SEQ ID NO: 99879 - RNA, 1701 nt, Artificial Sequence; identical to SEQ ID NO: 98598
  derived and/or modified sequence opt2 from hemagglutinin__InfluenzaA__AFD98310

SEQ ID NO: 99880 - RNA, 1701 nt, Artificial Sequence; identical to SEQ ID NO: 97966
  derived and/or modified sequence opt2 from hemagglutinin__InfluenzaA__AFD98320

SEQ ID NO: 99881 - RNA, 1701 nt, Artificial Sequence; identical to SEQ ID NO: 99866
  derived and/or modified sequence opt2 from hemagglutinin__InfluenzaA__AFD98340

SEQ ID NO: 99882 - RNA, 1701 nt, Artificial Sequence
  derived and/or modified sequence opt2 from hemagglutinin__InfluenzaA__AFD98351
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcaccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99883 - RNA, 1701 nt, Artificial Sequence
  derived and/or modified sequence opt2 from hemagglutinin__InfluenzaA__AFD98362
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcggccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucgucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99884 - RNA, 1701 nt, Artificial Sequence; identical to SEQ ID NO: 99863
  derived and/or modified sequence opt2 from hemagglutinin__InfluenzaA__AFD98373

SEQ ID NO: 99885 - RNA, 1701 nt, Artificial Sequence; identical to SEQ ID NO: 98494
  derived and/or modified sequence opt2 from hemagglutinin__InfluenzaA__AFD98384

SEQ ID NO: 99886 - RNA, 1701 nt, Artificial Sequence
  derived and/or modified sequence opt2 from hemagglutinin__InfluenzaA__AFD98395
augaagaccaucaucgcccucuccuacauccucugccucgucuucgcccagaagcuccccggcgacgacaacuccaccgccacccucugccucggccaccacgccguccccaacggcaccaucgucaagaccaucaccaacgaccagaucgaggucaccaacgccaccgagcucguccagaacuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99887 - RNA, 1701 nt, Artificial Sequence; identical to SEQ ID NO: 99863
  derived and/or modified sequence opt2 from hemagglutinin__InfluenzaA__AFD98406

SEQ ID NO: 99888 - RNA, 1701 nt, Artificial Sequence; identical to SEQ ID NO: 99866
  derived and/or modified sequence opt2 from hemagglutinin__InfluenzaA__AFD98417

SEQ ID NO: 99889 - RNA, 1701 nt, Artificial Sequence
  derived and/or modified sequence opt2 from hemagglutinin__InfluenzaA__AFD98428
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucaccaucuccugcuuccuccucugcgucgcccuccucggcuucaucaugugggccugccagaagggcaacauccgcugcaacaucugcaucuga

SEQ ID NO: 99890 - RNA, 1701 nt, Artificial Sequence; identical to SEQ ID NO: 98379
  derived and/or modified sequence opt2 from hemagglutinin__InfluenzaA__AFD98439

SEQ ID NO: 99891 - RNA, 1701 nt, Artificial Sequence
  derived and/or modified sequence opt2 from hemagglutinin__InfluenzaA__AFD98449
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaagaacuccuucuucucccgccucaacuggcucacccaccucaacuucaaguuccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99892 - RNA, 1701 nt, Artificial Sequence
  derived and/or modified sequence opt2 from hemagglutinin__InfluenzaA__AFD98460
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucuccaagcucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucuccaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99893 - RNA, 1701 nt, Artificial Sequence; identical to SEQ ID NO: 98379
  derived and/or modified sequence opt2 from hemagglutinin__InfluenzaA__AFD98471

SEQ ID NO: 99894 - RNA, 1701 nt, Artificial Sequence
  derived and/or modified sequence opt2 from hemagglutinin__InfluenzaA__AFD98481
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccgucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99895 - RNA, 1701 nt, Artificial Sequence; identical to SEQ ID NO: 98494
  derived and/or modified sequence opt2 from hemagglutinin__InfluenzaA__AFD98492

SEQ ID NO: 99896 - RNA, 1701 nt, Artificial Sequence
  derived and/or modified sequence opt2 from hemagglutinin__InfluenzaA__AFD98503
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagaccaagggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99897 - RNA, 1701 nt, Artificial Sequence; identical to SEQ ID NO: 98494
  derived and/or modified sequence opt2 from hemagglutinin__InfluenzaA__AFD98514

SEQ ID NO: 99898 - RNA, 1701 nt, Artificial Sequence; identical to SEQ ID NO: 99846
  derived and/or modified sequence opt2 from hemagglutinin__InfluenzaA__AFD98525

SEQ ID NO: 99899 - RNA, 1701 nt, Artificial Sequence; identical to SEQ ID NO: 98367
  derived and/or modified sequence opt2 from hemagglutinin__InfluenzaA__AFD98558

SEQ ID NO: 99900 - RNA, 1701 nt, Artificial Sequence
  derived and/or modified sequence opt2 from hemagglutinin__InfluenzaA__AFD98569
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacgagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 99901 - RNA, 1701 nt, Artificial Sequence; identical to SEQ ID NO: 98367
  derived and/or modified sequence opt2 from hemagglutinin__InfluenzaA__AFD98580

SEQ ID NO: 99902 - RNA, 1701 nt, Artificial Sequence
  derived and/or modified sequence opt2 from hemagglutinin__InfluenzaA__AFE02942
augaaggccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucuggaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggaccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99903 - RNA, 1701 nt, Artificial Sequence; identical to SEQ ID NO: 95345
  derived and/or modified sequence opt2 from hemagglutinin__InfluenzaA__AFE18688

SEQ ID NO: 99904 - RNA, 1701 nt, Artificial Sequence; identical to SEQ ID NO: 92162
  derived and/or modified sequence opt2 from hemagglutinin__InfluenzaA__AFE47624

SEQ ID NO: 99905 - RNA, 1701 nt, Artificial Sequence; identical to SEQ ID NO: 92912
  derived and/or modified sequence opt2 from hemagglutinin__InfluenzaA__AFE47635

SEQ ID NO: 99906 - RNA, 1701 nt, Artificial Sequence; identical to SEQ ID NO: 98494
  derived and/or modified sequence opt2 from hemagglutinin__InfluenzaA__AFF18506

SEQ ID NO: 99907 - RNA, 1701 nt, Artificial Sequence
  derived and/or modified sequence opt2 from hemagglutinin__InfluenzaA__AFF57124
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccaccgccgaccagcagcgccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99908 - RNA, 1701 nt, Artificial Sequence
  derived and/or modified sequence opt2 from hemagglutinin__InfluenzaA__AFF57128
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99909 - RNA, 1701 nt, Artificial Sequence
  derived and/or modified sequence opt2 from hemagglutinin__InfluenzaA__AFF57132
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcaguccaucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacgagaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99910 - RNA, 1701 nt, Artificial Sequence
  derived and/or modified sequence opt2 from hemagglutinin__InfluenzaA__AFF57136
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucuacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99911 - RNA, 1701 nt, Artificial Sequence
  derived and/or modified sequence opt2 from hemagglutinin__InfluenzaA__AFF57144
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgacgaccagcagucccucuaccagaacgaggacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99912 - RNA, 1701 nt, Artificial Sequence
  derived and/or modified sequence opt2 from hemagglutinin__InfluenzaA__AFF57148
augaaggccauccucgucguccuccucuacaccuucgccaccgccaacgccgacacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgacgaccagcagucccucuaccagaacgaggacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99913 - RNA, 1701 nt, Artificial Sequence
  derived and/or modified sequence opt2 from hemagglutinin__InfluenzaA__AFF57160
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgaccagcagucccucuaccagaacgaggacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99914 - RNA, 1701 nt, Artificial Sequence
  derived and/or modified sequence opt2 from hemagglutinin__InfluenzaA__AFF57164
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99915 - RNA, 1701 nt, Artificial Sequence; identical to SEQ ID NO: 99914
  derived and/or modified sequence opt2 from hemagglutinin__InfluenzaA__AFF57168

SEQ ID NO: 99916 - RNA, 1701 nt, Artificial Sequence
  derived and/or modified sequence opt2 from hemagglutinin__InfluenzaA__AFF57172
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgaggacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99917 - RNA, 1701 nt, Artificial Sequence
  derived and/or modified sequence opt2 from hemagglutinin__InfluenzaA__AFF57176
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99918 - RNA, 1701 nt, Artificial Sequence
  derived and/or modified sequence opt2 from hemagglutinin__InfluenzaA__AFF57184
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccagaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99919 - RNA, 1701 nt, Artificial Sequence; identical to SEQ ID NO: 99911
  derived and/or modified sequence opt2 from hemagglutinin__InfluenzaA__AFF57188

SEQ ID NO: 99920 - RNA, 1707 nt, Artificial Sequence
  derived and/or modified sequence opt2 from hemagglutinin__InfluenzaA__AFF60787
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccgaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 99921 - RNA, 1701 nt, Artificial Sequence
  derived and/or modified sequence opt2 from hemagglutinin__InfluenzaA__AFG29042
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuucuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99922 - RNA, 1701 nt, Artificial Sequence
  derived and/or modified sequence opt2 from hemagglutinin__InfluenzaA__AFG29044
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccaccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99923 - RNA, 1701 nt, Artificial Sequence; identical to SEQ ID NO: 94181
  derived and/or modified sequence opt2 from hemagglutinin__InfluenzaA__AFG31060

SEQ ID NO: 99924 - RNA, 1701 nt, Artificial Sequence; identical to SEQ ID NO: 96736
  derived and/or modified sequence opt2 from hemagglutinin__InfluenzaA__AFG31070

SEQ ID NO: 99925 - RNA, 1701 nt, Artificial Sequence; identical to SEQ ID NO: 94168
  derived and/or modified sequence opt2 from hemagglutinin__InfluenzaA__AFG31080

SEQ ID NO: 99926 - RNA, 1701 nt, Artificial Sequence
  derived and/or modified sequence opt2 from hemagglutinin__InfluenzaA__AFG31100
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 99927 - RNA, 1701 nt, Artificial Sequence; identical to SEQ ID NO: 94181
  derived and/or modified sequence opt2 from hemagglutinin__InfluenzaA__AFG31110

SEQ ID NO: 99928 - RNA, 1701 nt, Artificial Sequence; identical to SEQ ID NO: 94423
  derived and/or modified sequence opt2 from hemagglutinin__InfluenzaA__AFG31120

SEQ ID NO: 99929 - RNA, 1701 nt, Artificial Sequence; identical to SEQ ID NO: 94423
  derived and/or modified sequence opt2 from hemagglutinin__InfluenzaA__AFG31130

SEQ ID NO: 99930 - RNA, 1701 nt, Artificial Sequence; identical to SEQ ID NO: 94423
  derived and/or modified sequence opt2 from hemagglutinin__InfluenzaA__AFG31140

SEQ ID NO: 99931 - RNA, 1701 nt, Artificial Sequence; identical to SEQ ID NO: 95283
  derived and/or modified sequence opt2 from hemagglutinin__InfluenzaA__AFG31150

SEQ ID NO: 99932 - RNA, 1701 nt, Artificial Sequence; identical to SEQ ID NO: 95283
  derived and/or modified sequence opt2 from hemagglutinin__InfluenzaA__AFG31160

SEQ ID NO: 99933 - RNA, 1701 nt, Artificial Sequence; identical to SEQ ID NO: 94181
  derived and/or modified sequence opt2 from hemagglutinin__InfluenzaA__AFG31170

SEQ ID NO: 99934 - RNA, 1701 nt, Artificial Sequence; identical to SEQ ID NO: 94181
  derived and/or modified sequence opt2 from hemagglutinin__InfluenzaA__AFG31180

SEQ ID NO: 99935 - RNA, 1701 nt, Artificial Sequence; identical to SEQ ID NO: 94181
  derived and/or modified sequence opt2 from hemagglutinin__InfluenzaA__AFG31190

SEQ ID NO: 99936 - RNA, 1701 nt, Artificial Sequence; identical to SEQ ID NO: 94181
  derived and/or modified sequence opt2 from hemagglutinin__InfluenzaA__AFG31200

SEQ ID NO: 99937 - RNA, 1701 nt, Artificial Sequence; identical to SEQ ID NO: 94181
  derived and/or modified sequence opt2 from hemagglutinin__InfluenzaA__AFG31210

SEQ ID NO: 99938 - RNA, 1701 nt, Artificial Sequence; identical to SEQ ID NO: 94181
  derived and/or modified sequence opt2 from hemagglutinin__InfluenzaA__AFG31220

SEQ ID NO: 99939 - RNA, 1701 nt, Artificial Sequence; identical to SEQ ID NO: 96736
  derived and/or modified sequence opt2 from hemagglutinin__InfluenzaA__AFG31230

SEQ ID NO: 99940 - RNA, 1701 nt, Artificial Sequence; identical to SEQ ID NO: 94181
  derived and/or modified sequence opt2 from hemagglutinin__InfluenzaA__AFG31240

SEQ ID NO: 99941 - RNA, 1701 nt, Artificial Sequence; identical to SEQ ID NO: 94181
  derived and/or modified sequence opt2 from hemagglutinin__InfluenzaA__AFG31250

SEQ ID NO: 99942 - RNA, 1701 nt, Artificial Sequence; identical to SEQ ID NO: 94181
  derived and/or modified sequence opt2 from hemagglutinin__InfluenzaA__AFG31260

SEQ ID NO: 99943 - RNA, 1701 nt, Artificial Sequence; identical to SEQ ID NO: 94181
  derived and/or modified sequence opt2 from hemagglutinin__InfluenzaA__AFG31270

SEQ ID NO: 99944 - RNA, 1701 nt, Artificial Sequence; identical to SEQ ID NO: 94181
  derived and/or modified sequence opt2 from hemagglutinin__InfluenzaA__AFG31280

SEQ ID NO: 99945 - RNA, 1701 nt, Artificial Sequence; identical to SEQ ID NO: 94181
  derived and/or modified sequence opt2 from hemagglutinin__InfluenzaA__AFG31290

SEQ ID NO: 99946 - RNA, 1701 nt, Artificial Sequence
  derived and/or modified sequence opt2 from hemagglutinin__InfluenzaA__AFG31300
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacaucaaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 99947 - RNA, 1701 nt, Artificial Sequence; identical to SEQ ID NO: 96736
  derived and/or modified sequence opt2 from hemagglutinin__InfluenzaA__AFG31310

SEQ ID NO: 99948 - RNA, 1701 nt, Artificial Sequence; identical to SEQ ID NO: 94181
  derived and/or modified sequence opt2 from hemagglutinin__InfluenzaA__AFG31323

SEQ ID NO: 99949 - RNA, 1701 nt, Artificial Sequence; identical to SEQ ID NO: 94181
  derived and/or modified sequence opt2 from hemagglutinin__InfluenzaA__AFG31333

SEQ ID NO: 99950 - RNA, 1701 nt, Artificial Sequence; identical to SEQ ID NO: 94181
  derived and/or modified sequence opt2 from hemagglutinin__InfluenzaA__AFG31343

SEQ ID NO: 99951 - RNA, 1701 nt, Artificial Sequence; identical to SEQ ID NO: 94181
  derived and/or modified sequence opt2 from hemagglutinin__InfluenzaA__AFG31353

SEQ ID NO: 99952 - RNA, 1701 nt, Artificial Sequence; identical to SEQ ID NO: 94181
  derived and/or modified sequence opt2 from hemagglutinin__InfluenzaA__AFG31363

SEQ ID NO: 99953 - RNA, 1701 nt, Artificial Sequence; identical to SEQ ID NO: 94181
  derived and/or modified sequence opt2 from hemagglutinin__InfluenzaA__AFG31376

SEQ ID NO: 99954 - RNA, 1701 nt, Artificial Sequence; identical to SEQ ID NO: 94181
  derived and/or modified sequence opt2 from hemagglutinin__InfluenzaA__AFG31386

SEQ ID NO: 99955 - RNA, 1701 nt, Artificial Sequence; identical to SEQ ID NO: 94181
  derived and/or modified sequence opt2 from hemagglutinin__InfluenzaA__AFG31396

SEQ ID NO: 99956 - RNA, 1701 nt, Artificial Sequence; identical to SEQ ID NO: 94181
  derived and/or modified sequence opt2 from hemagglutinin__InfluenzaA__AFG31406

SEQ ID NO: 99957 - RNA, 1701 nt, Artificial Sequence; identical to SEQ ID NO: 94181
  derived and/or modified sequence opt2 from hemagglutinin__InfluenzaA__AFG31416

SEQ ID NO: 99958 - RNA, 1701 nt, Artificial Sequence; identical to SEQ ID NO: 94181
  derived and/or modified sequence opt2 from hemagglutinin__InfluenzaA__AFG31426

SEQ ID NO: 99959 - RNA, 1701 nt, Artificial Sequence; identical to SEQ ID NO: 94181
  derived and/or modified sequence opt2 from hemagglutinin__InfluenzaA__AFG31436

SEQ ID NO: 99960 - RNA, 1701 nt, Artificial Sequence; identical to SEQ ID NO: 94181
  derived and/or modified sequence opt2 from hemagglutinin__InfluenzaA__AFG31446

SEQ ID NO: 99961 - RNA, 1701 nt, Artificial Sequence; identical to SEQ ID NO: 94181
  derived and/or modified sequence opt2 from hemagglutinin__InfluenzaA__AFG31456

SEQ ID NO: 99962 - RNA, 1701 nt, Artificial Sequence; identical to SEQ ID NO: 94181
  derived and/or modified sequence opt2 from hemagglutinin__InfluenzaA__AFG31466

SEQ ID NO: 99963 - RNA, 1701 nt, Artificial Sequence; identical to SEQ ID NO: 95283
  derived and/or modified sequence opt2 from hemagglutinin__InfluenzaA__AFG31486

SEQ ID NO: 99964 - RNA, 1701 nt, Artificial Sequence; identical to SEQ ID NO: 94181
  derived and/or modified sequence opt2 from hemagglutinin__InfluenzaA__AFG31496

SEQ ID NO: 99965 - RNA, 1701 nt, Artificial Sequence; identical to SEQ ID NO: 94181
  derived and/or modified sequence opt2 from hemagglutinin__InfluenzaA__AFG31506

SEQ ID NO: 99966 - RNA, 1701 nt, Artificial Sequence; identical to SEQ ID NO: 94181
  derived and/or modified sequence opt2 from hemagglutinin__InfluenzaA__AFG31516

SEQ ID NO: 99967 - RNA, 1701 nt, Artificial Sequence; identical to SEQ ID NO: 94272
  derived and/or modified sequence opt2 from hemagglutinin__InfluenzaA__AFG31526

SEQ ID NO: 99968 - RNA, 1701 nt, Artificial Sequence; identical to SEQ ID NO: 94181
  derived and/or modified sequence opt2 from hemagglutinin__InfluenzaA__AFG31536

SEQ ID NO: 99969 - RNA, 1701 nt, Artificial Sequence; identical to SEQ ID NO: 96736
  derived and/or modified sequence opt2 from hemagglutinin__InfluenzaA__AFG31546

SEQ ID NO: 99970 - RNA, 1701 nt, Artificial Sequence; identical to SEQ ID NO: 96736
  derived and/or modified sequence opt2 from hemagglutinin__InfluenzaA__AFG31556

SEQ ID NO: 99971 - RNA, 1701 nt, Artificial Sequence; identical to SEQ ID NO: 94181
  derived and/or modified sequence opt2 from hemagglutinin__InfluenzaA__AFG31566

SEQ ID NO: 99972 - RNA, 1701 nt, Artificial Sequence; identical to SEQ ID NO: 94423
  derived and/or modified sequence opt2 from hemagglutinin__InfluenzaA__AFG31586

SEQ ID NO: 99973 - RNA, 1701 nt, Artificial Sequence; identical to SEQ ID NO: 94423
  derived and/or modified sequence opt2 from hemagglutinin__InfluenzaA__AFG31596

SEQ ID NO: 99974 - RNA, 1701 nt, Artificial Sequence; identical to SEQ ID NO: 94423
  derived and/or modified sequence opt2 from hemagglutinin__InfluenzaA__AFG31606

SEQ ID NO: 99975 - RNA, 1701 nt, Artificial Sequence; identical to SEQ ID NO: 94423
  derived and/or modified sequence opt2 from hemagglutinin__InfluenzaA__AFG31616

SEQ ID NO: 99976 - RNA, 1701 nt, Artificial Sequence; identical to SEQ ID NO: 94423
  derived and/or modified sequence opt2 from hemagglutinin__InfluenzaA__AFG31626

SEQ ID NO: 99977 - RNA, 1701 nt, Artificial Sequence; identical to SEQ ID NO: 94181
  derived and/or modified sequence opt2 from hemagglutinin__InfluenzaA__AFG31636

SEQ ID NO: 99978 - RNA, 1701 nt, Artificial Sequence; identical to SEQ ID NO: 94181
  derived and/or modified sequence opt2 from hemagglutinin__InfluenzaA__AFG31646

SEQ ID NO: 99979 - RNA, 1701 nt, Artificial Sequence; identical to SEQ ID NO: 95345
  derived and/or modified sequence opt2 from hemagglutinin__InfluenzaA__AFG31656

SEQ ID NO: 99980 - RNA, 1701 nt, Artificial Sequence; identical to SEQ ID NO: 95345
  derived and/or modified sequence opt2 from hemagglutinin__InfluenzaA__AFG31666

SEQ ID NO: 99981 - RNA, 1701 nt, Artificial Sequence
  derived and/or modified sequence opt2 from hemagglutinin__InfluenzaA__AFG71865
augaagaccaucaucgcccucuccuacaucuucugccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcaucggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 99982 - RNA, 1701 nt, Artificial Sequence; identical to SEQ ID NO: 93068
  derived and/or modified sequence opt2 from hemagglutinin__InfluenzaA__AFG71876

SEQ ID NO: 99983 - RNA, 1701 nt, Artificial Sequence
  derived and/or modified sequence opt2 from hemagglutinin__InfluenzaA__AFG71898
augaagaccaucaucgcccucuccuaccucuucugccucgccuucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaccaccgagggcuucaccuggaccggcgucacccagaacggcggcuccaacgccugcaagcgcggccccggcuccggcuucuucucccgccucaacuggcucaccaaguccggcuccaccuaccccguccucaacgucaccauguccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcgucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 99984 - RNA, 1701 nt, Artificial Sequence
  derived and/or modified sequence opt2 from hemagglutinin__InfluenzaA__AFG71920
augaagaccaucaucgcccucuccuacaucuucugccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucaucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 99985 - RNA, 1701 nt, Artificial Sequence
  derived and/or modified sequence opt2 from hemagglutinin__InfluenzaA__AFG71931
augaagaccaucaucgcccucuccuacaucuucugccucgucaucggccaggaccuccccggcaacgagaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcaucggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 99986 - RNA, 1701 nt, Artificial Sequence
  derived and/or modified sequence opt2 from hemagglutinin__InfluenzaA__AFG71942
augaagaccaucaucgcccucuccuacaucuucuaccucgcccucucccaggaccuccccggcaacgacaacuccaaggccacccucugccucggccaccacgccguccccaacggcacccucgucaagaccaucaccgacgaccagaccgaggucaccaacgccaccgagcucguccaguccuccuccaccggcaagaucugcaacaacccccaccgcauccucgacggcauggacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccgaggucacccagaacggcggcuccaucgccugcaagcgcggccccgacuccggcuucuucucccgccucaacuggcucaccaaguccggccgcaccuaccccguccucaacgucaccaugcccaacaacgacaacuucgacaagcucuacaucuggggcguccaccaccccuccaccgaccaggagcagaccaaccucuacguccagaccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 99987 - RNA, 1701 nt, Artificial Sequence
  derived and/or modified sequence opt2 from hemagglutinin__InfluenzaA__AFG71953
augaagaccaucaucgcccucuccuacaucuucugccucguccucggccaggaccuccccggcaacgacaaguccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccaccaagcgcucccagcagaccaucauccccaacaucggcucccgccccuggguccgcggccccuccucccgcaucuccaucuacuggaccaccgucaagcccggcgacauccucaucaucaacuccaacggcaaccucaucgccccccgcggcuacuucaagaugcgcaccggcaaguccuccaucaugcgcuccgacgcccccaucggcgccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcgucaucaugugggccugccagaagggcaacauccgcugcaacaucugcaucuga

SEQ ID NO: 99988 - RNA, 1701 nt, Artificial Sequence; identical to SEQ ID NO: 91817
  derived and/or modified sequence opt2 from hemagglutinin__InfluenzaA__AFG71975

SEQ ID NO: 99989 - RNA, 1701 nt, Artificial Sequence
  derived and/or modified sequence opt2 from hemagglutinin__InfluenzaA__AFG71996
augaagaccaucaucgcccucuccuacaucuucugccucguccucggccagaacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacaucggcuucuucucccgccucaacuggcucuacaaguccggcaacaccuaccccguccucaacgucuccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgccuccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99990 - RNA, 1701 nt, Artificial Sequence
  derived and/or modified sequence opt2 from hemagglutinin__InfluenzaA__AFG72007
augaagaccaucaucgcccucuccuacaucuucugccucguccucggccgcgacuucccccgcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcauggacugcacccucaucgacgcccuccucggcgacccccacugcgacggccuccagaacggcaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcaacaccuaccccguccucaacgucaccaugcccaacaacgacaacuucgacaagcucuacaucuggggcguccaccaccccuccaccgaccaggaccagaccucccucuacguccaggccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccaccgcugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99991 - RNA, 1701 nt, Artificial Sequence
  derived and/or modified sequence opt2 from hemagglutinin__InfluenzaA__AFG72029
augaagaccaucaucgcccucuccuacaucuucugccucgucuucggccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucaucgccuccuccggcacccucgaguucaucaacgagggcuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99992 - RNA, 1701 nt, Artificial Sequence
  derived and/or modified sequence opt2 from hemagglutinin__InfluenzaA__AFG72040
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgagaacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99993 - RNA, 1701 nt, Artificial Sequence
  derived and/or modified sequence opt2 from hemagglutinin__InfluenzaA__AFG72051
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcaaccagcagaccgucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccacaacggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccgcaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99994 - RNA, 1701 nt, Artificial Sequence
  derived and/or modified sequence opt2 from hemagglutinin__InfluenzaA__AFG72085
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaucggcgucacccaguccggcggcuccugcgccugcaagcgcggcuccgucaacuccuucuucucccgccucaacuggcuccacgaguccgagcagaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaucggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99995 - RNA, 1701 nt, Artificial Sequence
  derived and/or modified sequence opt2 from hemagglutinin__InfluenzaA__AFG72107
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucaucgccuccuccggcacccucgaguucaucaacgaggaguucaacuggaccggcgucacccagaacggcggcuccuacgccugcaagcgcggcuccgucaacuccuucuucucccgccucaacuggcuccacgaguccgaguacaaguaccccgcccucaacgucaccaugcccaacaacggccgcuucgacaagcucuacaucuggggcguccaccaccccuccaccgaccgcgagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccacaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggccgucaacaaccgcuuccagaucaagggcgucgagcucaaguccggcuacaaggacuggauccucuggaucuccuucgccaucuccugcuuccuccucugcgucauccuccucggcuucaucaugugggccugccagaagggcaacauccgcugcaacaucugcaucuga

SEQ ID NO: 99996 - RNA, 1701 nt, Artificial Sequence
  derived and/or modified sequence opt2 from hemagglutinin__InfluenzaA__AFG72118
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcaacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99997 - RNA, 1701 nt, Artificial Sequence
  derived and/or modified sequence opt2 from hemagglutinin__InfluenzaA__AFG72129
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccuccggcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99998 - RNA, 1701 nt, Artificial Sequence
  derived and/or modified sequence opt2 from hemagglutinin__InfluenzaA__AFG72140
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgcccucggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacaacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 99999 - RNA, 1701 nt, Artificial Sequence
  derived and/or modified sequence opt2 from hemagglutinin__InfluenzaA__AFG72151
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100000 - RNA, 1701 nt, Artificial Sequence
  derived and/or modified sequence opt2 from hemagglutinin__InfluenzaA__AFG72184
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgagcgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100001 - RNA, 1701 nt, Artificial Sequence; identical to SEQ ID NO: 99999
  derived and/or modified sequence opt2 from hemagglutinin__InfluenzaA__AFG72195

SEQ ID NO: 100002 - RNA, 1701 nt, Artificial Sequence
  derived and/or modified sequence opt2 from hemagglutinin__InfluenzaA__AFG72206
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100003 - RNA, 1701 nt, Artificial Sequence
  derived and/or modified sequence opt2 from hemagglutinin__InfluenzaA__AFG72217
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgacaucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggaccucauccucuggaucuccuucgccaucuccugcuuccuccucugcgucguccuccucggcuucaucaugugggccugccagaagggcaacauccgcugcaacaucugcaucuga

SEQ ID NO: 100004 - RNA, 1701 nt, Artificial Sequence
  derived and/or modified sequence opt2 from hemagglutinin__InfluenzaA__AFG72228
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgagcucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100005 - RNA, 1701 nt, Artificial Sequence
  derived and/or modified sequence opt2 from hemagglutinin__InfluenzaA__AFG72239
augaagaccaucaucgcccucuccuacauccucugccucguccucgcccagaagcuccccggcuccgacaacuccaccgccacccucugccucggccaccacgccguccccaacggcacccucgucaagaccaucaccaacgaccagaucgaggucaccaacgccaccgagcucguccaguccuccaccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100006 - RNA, 1701 nt, Artificial Sequence; identical to SEQ ID NO: 99999
  derived and/or modified sequence opt2 from hemagglutinin__InfluenzaA__AFG72272

SEQ ID NO: 100007 - RNA, 1701 nt, Artificial Sequence
  derived and/or modified sequence opt2 from hemagglutinin__InfluenzaA__AFG72316
augaagaccaucaucgcccucucccacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacguccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100008 - RNA, 1701 nt, Artificial Sequence
  derived and/or modified sequence opt2 from hemagglutinin__InfluenzaA__AFG72339
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaucaacgaggacuucaacuggaccggcgucgcccaggacggcggcuccuacaccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100009 - RNA, 1701 nt, Artificial Sequence
  derived and/or modified sequence opt2 from hemagglutinin__InfluenzaA__AFG72350
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaucaacgaggacuucaacuggaccggcgucgcccaggacggccgcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaucugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100010 - RNA, 1701 nt, Artificial Sequence
  derived and/or modified sequence opt2 from hemagglutinin__InfluenzaA__AFG72372
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacaccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100011 - RNA, 1701 nt, Artificial Sequence; identical to SEQ ID NO: 92536
  derived and/or modified sequence opt2 from hemagglutinin__InfluenzaA__AFG72383

SEQ ID NO: 100012 - RNA, 1701 nt, Artificial Sequence
  derived and/or modified sequence opt2 from hemagglutinin__InfluenzaA__AFG72394
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucgccaccaagcgcucccagcagaccgucauccccaacaucggcuuccgccccuggguccgcggccaguccuccggcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100013 - RNA, 1701 nt, Artificial Sequence
  derived and/or modified sequence opt2 from hemagglutinin__InfluenzaA__AFG72405
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgaccccaacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaggacggcggcuccuacgccugcaagcgcggcuccgucaaguccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100014 - RNA, 1701 nt, Artificial Sequence
  derived and/or modified sequence opt2 from hemagglutinin__InfluenzaA__AFG72449
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcuacuccccccaccgcauccucgacggcaacaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaagggcuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcggcgucaccgucuccaccaagcgcucccagcagaccgucauccccuccaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100015 - RNA, 1701 nt, Artificial Sequence; identical to SEQ ID NO: 92565
  derived and/or modified sequence opt2 from hemagglutinin__InfluenzaA__AFG72460

SEQ ID NO: 100016 - RNA, 1701 nt, Artificial Sequence
  derived and/or modified sequence opt2 from hemagglutinin__InfluenzaA__AFG72504
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucauccgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100017 - RNA, 1701 nt, Artificial Sequence
  derived and/or modified sequence opt2 from hemagglutinin__InfluenzaA__AFG72515
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100018 - RNA, 1701 nt, Artificial Sequence
  derived and/or modified sequence opt2 from hemagglutinin__InfluenzaA__AFG72526
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccuccugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaucgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccagaccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100019 - RNA, 1701 nt, Artificial Sequence
  derived and/or modified sequence opt2 from hemagglutinin__InfluenzaA__AFG72581
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcggcgucaccgucuccaccaagcgcucccagcagaccgucauccccaacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100020 - RNA, 1701 nt, Artificial Sequence
  derived and/or modified sequence opt2 from hemagglutinin__InfluenzaA__AFG72603
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaccgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100021 - RNA, 1701 nt, Artificial Sequence
  derived and/or modified sequence opt2 from hemagglutinin__InfluenzaA__AFG72614
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacuccugcaagcgcggcuccgucaaguccuucuucucccgccucaacuggcuccacaagcucgaguacaaguaccccgcccucaacgucgccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100022 - RNA, 1701 nt, Artificial Sequence
  derived and/or modified sequence opt2 from hemagglutinin__InfluenzaA__AFG72625
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaaguccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100023 - RNA, 1701 nt, Artificial Sequence
  derived and/or modified sequence opt2 from hemagglutinin__InfluenzaA__AFG72636
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaaguccuucuucucccgccucaacuggcuccacaagcucgaguucaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100024 - RNA, 1701 nt, Artificial Sequence
  derived and/or modified sequence opt2 from hemagglutinin__InfluenzaA__AFG72658
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100025 - RNA, 1701 nt, Artificial Sequence
  derived and/or modified sequence opt2 from hemagglutinin__InfluenzaA__AFG72680
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaucaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccacccgccgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaaccgcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100026 - RNA, 1701 nt, Artificial Sequence
  derived and/or modified sequence opt2 from hemagglutinin__InfluenzaA__AFG72691
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100027 - RNA, 1701 nt, Artificial Sequence
  derived and/or modified sequence opt2 from hemagglutinin__InfluenzaA__AFG72713
augaagaucaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucuccuccaccggcaaccucaucgccccccgcggcuacuucaagauccgcuccggcaaguccuccaucauccgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100028 - RNA, 1701 nt, Artificial Sequence
  derived and/or modified sequence opt2 from hemagglutinin__InfluenzaA__AFG72724
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgucugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100029 - RNA, 1701 nt, Artificial Sequence
  derived and/or modified sequence opt2 from hemagglutinin__InfluenzaA__AFG72735
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaccgucaccaugcccaacaacgacaaguucgacaagcucuacaucuggggcguccaccaccccuccaccgacuccgaccagaccuccaucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgacaucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100030 - RNA, 1701 nt, Artificial Sequence
  derived and/or modified sequence opt2 from hemagglutinin__InfluenzaA__AFG72757
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgcuccuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccuccaucuacgcccaggccuccggccgcgucaccgucuccaccaagcgcucccagcagaccgucauccccaacaucggcucccgccccuggguccgcggcaucuccucccgcaucuccauccacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100031 - RNA, 1701 nt, Artificial Sequence
  derived and/or modified sequence opt2 from hemagglutinin__InfluenzaA__AFG72779
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccacccgccgcucccagcagaccgucauccccaacaucggcucccgccccuggguccgcggcgucuccuccggcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100032 - RNA, 1701 nt, Artificial Sequence
  derived and/or modified sequence opt2 from hemagglutinin__InfluenzaA__AFG72801
augaagaccaucaucgcccucuccuacauccucugccucgucuucgcccagaagcuccccggcaacgacaacuccaccgccacccucugccucggccaccacgccgucuccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucuccaucuacgcccaguccuccggccgcgucaccgucuccaccaagcgcucccagcagaccgucauccccaacaucggcuccucccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100033 - RNA, 1701 nt, Artificial Sequence
  derived and/or modified sequence opt2 from hemagglutinin__InfluenzaA__AFG72812
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccucaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100034 - RNA, 1701 nt, Artificial Sequence
  derived and/or modified sequence opt2 from hemagglutinin__InfluenzaA__AFG72823
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccuccaccccggcaccgacuccgaccagaucucccucuacgcccaggccuccggccgcaucaccgucuccaccaagcgcucccagcagaccgucauccccaacaucggcucccgcccccgcguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100035 - RNA, 1701 nt, Artificial Sequence
  derived and/or modified sequence opt2 from hemagglutinin__InfluenzaA__AFG72834
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100036 - RNA, 1701 nt, Artificial Sequence
  derived and/or modified sequence opt2 from hemagglutinin__InfluenzaA__AFG72845
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcuccgcuacaaguaccccgcccucaacgucaccaugcccaacaacgagaaguucgacaagcucuacaucuggggcguccaccaccccggcaccgacuccgaccagaucucccucuacgcccaggccuccggccgcgucaccaucuccaccaagcgcucccagcagaccgucauccccaacaucggcucccgccccuggguccgcggcgucuccucccgcaucuccauccacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100037 - RNA, 1701 nt, Artificial Sequence
  derived and/or modified sequence opt2 from hemagglutinin__InfluenzaA__AFG72856
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaccaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaacaagcucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100038 - RNA, 1701 nt, Artificial Sequence
  derived and/or modified sequence opt2 from hemagglutinin__InfluenzaA__AFG72867
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaagaacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100039 - RNA, 1701 nt, Artificial Sequence
  derived and/or modified sequence opt2 from hemagglutinin__InfluenzaA__AFG72922
augaagaccaucaucgcccucuccuacauccucugccucgucuucgcccagaagcuccccggcgacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100040 - RNA, 1701 nt, Artificial Sequence
  derived and/or modified sequence opt2 from hemagglutinin__InfluenzaA__AFG72933
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcguccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100041 - RNA, 1701 nt, Artificial Sequence
  derived and/or modified sequence opt2 from hemagglutinin__InfluenzaA__AFG72955
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccuccgcuucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100042 - RNA, 1701 nt, Artificial Sequence; identical to SEQ ID NO: 93152
  derived and/or modified sequence opt2 from hemagglutinin__InfluenzaA__AFG98808

SEQ ID NO: 100043 - RNA, 1701 nt, Artificial Sequence; identical to SEQ ID NO: 93152
  derived and/or modified sequence opt2 from hemagglutinin__InfluenzaA__AFG98819

SEQ ID NO: 100044 - RNA, 1701 nt, Artificial Sequence
  derived and/or modified sequence opt2 from hemagglutinin__InfluenzaA__AFG98830
augaagaccaucaucgcccucuccuacaucuucugccucguccucggccaggaccuccccggcaacgacaaguccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccuccgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacauccucaucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100045 - RNA, 1701 nt, Artificial Sequence
  derived and/or modified sequence opt2 from hemagglutinin__InfluenzaA__AFG98841
augaagaccaucaucgcccucuccuacaucuucugccucguccucggccaggaccuccccggcaacgacaaguccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacauccucaucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100046 - RNA, 1701 nt, Artificial Sequence; identical to SEQ ID NO: 91817
  derived and/or modified sequence opt2 from hemagglutinin__InfluenzaA__AFG98852

SEQ ID NO: 100047 - RNA, 1701 nt, Artificial Sequence
  derived and/or modified sequence opt2 from hemagglutinin__InfluenzaA__AFG98863
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccuccgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100048 - RNA, 1701 nt, Artificial Sequence
  derived and/or modified sequence opt2 from hemagglutinin__InfluenzaA__AFG98874
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacaacggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100049 - RNA, 1701 nt, Artificial Sequence
  derived and/or modified sequence opt2 from hemagglutinin__InfluenzaA__AFG98885
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggcaccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100050 - RNA, 1701 nt, Artificial Sequence
  derived and/or modified sequence opt2 from hemagglutinin__InfluenzaA__AFG98896
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccgccuaccccguccucaacgucaccaugcccaacaacgacaacuucgacaagcucuacaucuggggcguccaccaccccuccaccgaccaggagcagaccaaccucuacguccagaccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100051 - RNA, 1701 nt, Artificial Sequence
  derived and/or modified sequence opt2 from hemagglutinin__InfluenzaA__AFG98907
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacugcggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100052 - RNA, 1701 nt, Artificial Sequence
  derived and/or modified sequence opt2 from hemagglutinin__InfluenzaA__AFG98918
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgaccgcggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100053 - RNA, 1701 nt, Artificial Sequence
  derived and/or modified sequence opt2 from hemagglutinin__InfluenzaA__AFG98929
augaagaccgucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacaucggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100054 - RNA, 1701 nt, Artificial Sequence
  derived and/or modified sequence opt2 from hemagglutinin__InfluenzaA__AFG98940
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccucaacgucaccaugcccaacaaggacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggcauguccucccgcaucuccaucuacuggaccaucgucaagcccggcgacauccucgucaucaacuccaacggcaaccucaucgccccccgcggcuacuucaagaugcgcaccggccgcuccuccaucaugcgcuccgacgcccccaucggcaccugcaucuccgagugcaucacccccaacggcuccauccccaacgaccgccccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100055 - RNA, 1701 nt, Artificial Sequence
  derived and/or modified sequence opt2 from hemagglutinin__InfluenzaA__AFG98962
augaagaccaucaucgcccucuccuacaucuucugccucguccucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100056 - RNA, 1701 nt, Artificial Sequence
  derived and/or modified sequence opt2 from hemagglutinin__InfluenzaA__AFG98973
augaagaccaucaucgcccucuccuacaucuucugccucguccucggccaggacuucccccgcaacgacaacuccaccgccacccucugccucggccaccacgccguccccaacggcacccucgucaagaccaucaccaacgaccagaucgaggucaccaacgccaacgagcucguccaguccuccuccaccggcaagaucugcaacaacccccaccgcauccucgacggcauggacugcacccucaucgacgcccuccucggcgacccccacugcgacggccuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgaccgcggcuucuucucccgccucaacuggcucuacaaguccggcaacaccuaccccguccucaacgucaccaugcccaacaacgacaacuucgacaagcucuacaucuggggcguccaccaccccuccaccgaccaggaccagaccucccucuacguccaggccuccggccgcgucaccgucuccaccaagcgcucccagcagaccgucauccccaacaucggcccccgccccuggguccgcggccucuccuccggcaucuccaucuacuggaccaucgucaagcccggcgacauccuccucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccaccgcugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100057 - RNA, 1701 nt, Artificial Sequence
  derived and/or modified sequence opt2 from hemagglutinin__InfluenzaA__AFG98984
augaagaccaucaucgcccucuccuacaucuucugccucguccucggccaggacuucccccgcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcauggacugcacccucaucgacgcccuccucggcgacccccacugcgacggccuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgaccgcggcuucuucucccgccucaacuggcucuacaaguccggcaacaccuaccccguccucaacgucaccaugcccaacaacgacaacuucgacaagcucuacaucuggggcguccaccaccccuccaccgaccaggaccagaccucccucuacguccaggccuccggccgcgucaccgucuccaccaagcgcucccagcagaccgucauccccaacaucggcccccgccccuggguccgcggccucuccuccggcaucuccaucuacuggaccaucgucaagcccggcgacauccuccucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccaccgcugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100058 - RNA, 1704 nt, Artificial Sequence
  derived and/or modified sequence opt2 from hemagglutinin__InfluenzaA__AFG98995
augaagaccaucaucgcccucuccuacaucuucugccucgucuucgcccaggaccuccccggcaacgacaacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacaucggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100059 - RNA, 1701 nt, Artificial Sequence
  derived and/or modified sequence opt2 from hemagglutinin__InfluenzaA__AFG99006
augaagaccaucaucgcccucuccuacaucuucugccucguccucggccaggacuucccccgcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcauggacugcacccucaucgacgcccuccucggcgacccccacugcgacggccuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgaccgcggcuucuucucccgccucaacuggcucuacaaguccggcaacaccuaccccguccucaacgucaccaugcccaacaacgacaacuucgacaagcucuacaucuggggcguccaccaccccuccaccgaccaggaccagaccucccucuacguccaggccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccaccgcugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100060 - RNA, 1701 nt, Artificial Sequence; identical to SEQ ID NO: 92276
  derived and/or modified sequence opt2 from hemagglutinin__InfluenzaA__AFG99017

SEQ ID NO: 100061 - RNA, 1701 nt, Artificial Sequence
  derived and/or modified sequence opt2 from hemagglutinin__InfluenzaA__AFG99028
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcggcaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100062 - RNA, 1701 nt, Artificial Sequence
  derived and/or modified sequence opt2 from hemagglutinin__InfluenzaA__AFG99039
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucgccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100063 - RNA, 1701 nt, Artificial Sequence; identical to SEQ ID NO: 92276
  derived and/or modified sequence opt2 from hemagglutinin__InfluenzaA__AFG99050

SEQ ID NO: 100064 - RNA, 1701 nt, Artificial Sequence
  derived and/or modified sequence opt2 from hemagglutinin__InfluenzaA__AFG99061
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacaucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaacaaggucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100065 - RNA, 1701 nt, Artificial Sequence
  derived and/or modified sequence opt2 from hemagglutinin__InfluenzaA__AFG99072
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgaccgccucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100066 - RNA, 1701 nt, Artificial Sequence
  derived and/or modified sequence opt2 from hemagglutinin__InfluenzaA__AFG99083
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaagggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcucaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccacgaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100067 - RNA, 1701 nt, Artificial Sequence
  derived and/or modified sequence opt2 from hemagglutinin__InfluenzaA__AFG99094
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccggcgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100068 - RNA, 1701 nt, Artificial Sequence
  derived and/or modified sequence opt2 from hemagglutinin__InfluenzaA__AFG99116
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100069 - RNA, 1701 nt, Artificial Sequence
  derived and/or modified sequence opt2 from hemagglutinin__InfluenzaA__AFG99127
augaagaccaucaucgcccucuccuacauccucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100070 - RNA, 1701 nt, Artificial Sequence
  derived and/or modified sequence opt2 from hemagglutinin__InfluenzaA__AFG99138
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuccgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcaaccagcagaccgucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccgcaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100071 - RNA, 1701 nt, Artificial Sequence
  derived and/or modified sequence opt2 from hemagglutinin__InfluenzaA__AFG99149
augaagaccaucaucgcccucuccuacauccucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcucccgcgccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacgccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100072 - RNA, 1701 nt, Artificial Sequence
  derived and/or modified sequence opt2 from hemagglutinin__InfluenzaA__AFG99171
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaccaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcaaccagcagaccgucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccgcaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100073 - RNA, 1701 nt, Artificial Sequence
  derived and/or modified sequence opt2 from hemagglutinin__InfluenzaA__AFG99182
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguacaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100074 - RNA, 1701 nt, Artificial Sequence
  derived and/or modified sequence opt2 from hemagglutinin__InfluenzaA__AFG99193
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccgcccucaacgucaccaugcccaacaacggcaaguucgagaagcucuacaucuggggcguccaccaccccuccaccgacaaggagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgacaugaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100075 - RNA, 1701 nt, Artificial Sequence
  derived and/or modified sequence opt2 from hemagglutinin__InfluenzaA__AFG99204
augaagaccaucaucgcccucuccuacaucuucugccucggcuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacaaguccgaguccaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucauccgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100076 - RNA, 1701 nt, Artificial Sequence
  derived and/or modified sequence opt2 from hemagglutinin__InfluenzaA__AFG99215
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucaucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguacaaguaccccgcccucaacgucaccaugcccaacaacggcaaguucgacaagcucuacaucuggggcguccaccaccccuccaccgagaaggagcagaccaaccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100077 - RNA, 1701 nt, Artificial Sequence
  derived and/or modified sequence opt2 from hemagglutinin__InfluenzaA__AFG99226
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguacaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccucuccaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100078 - RNA, 1701 nt, Artificial Sequence
  derived and/or modified sequence opt2 from hemagglutinin__InfluenzaA__AFG99237
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcgaguccgucaacuccuucuucucccgccucaacuggcucuacgaguccgaguacaaguaccccgcccucaacgucaccaugcccaacaacggcaaguucgagaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacguccgccagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100079 - RNA, 1701 nt, Artificial Sequence
  derived and/or modified sequence opt2 from hemagglutinin__InfluenzaA__AFG99248
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcucccacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccaucaccgaccgcgagcagaccaaccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100080 - RNA, 1701 nt, Artificial Sequence
  derived and/or modified sequence opt2 from hemagglutinin__InfluenzaA__AFG99259
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccaggucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100081 - RNA, 1701 nt, Artificial Sequence
  derived and/or modified sequence opt2 from hemagglutinin__InfluenzaA__AFG99270
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccacaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100082 - RNA, 1701 nt, Artificial Sequence
  derived and/or modified sequence opt2 from hemagglutinin__InfluenzaA__AFG99281
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaggaguucaacuggaccggcgucacccaguccggcggcuccuacgccugcaagcgcggcuccgucaacuccuucuucucccgccucaacuggcuccacaaguccgaguacaaguaccccgcccucaacgucaccaugcccaacaacggccgcuucgacaagcucuacaucuggggcguccaccaccccuccaccgaccgcgagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccacaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgacaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100083 - RNA, 1701 nt, Artificial Sequence
  derived and/or modified sequence opt2 from hemagglutinin__InfluenzaA__AFG99292
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccaggucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100084 - RNA, 1701 nt, Artificial Sequence
  derived and/or modified sequence opt2 from hemagglutinin__InfluenzaA__AFG99303
augaagaccaucaucgcccucuccuacaucuucugccucgucgucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100085 - RNA, 1701 nt, Artificial Sequence
  derived and/or modified sequence opt2 from hemagglutinin__InfluenzaA__AFG99314
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacuccuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcauccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagcuccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100086 - RNA, 1701 nt, Artificial Sequence
  derived and/or modified sequence opt2 from hemagglutinin__InfluenzaA__AFG99336
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100087 - RNA, 1701 nt, Artificial Sequence
  derived and/or modified sequence opt2 from hemagglutinin__InfluenzaA__AFG99347
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacaagcccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgacaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100088 - RNA, 1701 nt, Artificial Sequence
  derived and/or modified sequence opt2 from hemagglutinin__InfluenzaA__AFG99358
augaagaccaucaucgcccucucccacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaucggcaaccucaucgccccccgcggcuacuucaagauccgcaacggcaaguccuccaucaugcgcuccgacguccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100089 - RNA, 1701 nt, Artificial Sequence
  derived and/or modified sequence opt2 from hemagglutinin__InfluenzaA__AFG99369
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacugggccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 100090 - RNA, 1701 nt, Artificial Sequence
  derived and/or modified sequence opt2 from hemagglutinin__InfluenzaA__AFG99380
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100091 - RNA, 1701 nt, Artificial Sequence; identical to SEQ ID NO: 100090
  derived and/or modified sequence opt2 from hemagglutinin__InfluenzaA__AFG99391

SEQ ID NO: 100092 - RNA, 1701 nt, Artificial Sequence
  derived and/or modified sequence opt2 from hemagglutinin__InfluenzaA__AFG99402
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccgucaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100093 - RNA, 1701 nt, Artificial Sequence
  derived and/or modified sequence opt2 from hemagglutinin__InfluenzaA__AFG99413
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100094 - RNA, 1701 nt, Artificial Sequence
  derived and/or modified sequence opt2 from hemagglutinin__InfluenzaA__AFG99424
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100095 - RNA, 1701 nt, Artificial Sequence
  derived and/or modified sequence opt2 from hemagglutinin__InfluenzaA__AFG99435
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacggccuccagaacaaggagugggaccucuucgucgagcgcuccaaggccuacuccaacugcuaccccuacgacguccccgacuacgccucccuccgcucccucgucgccuccuccggcacccucgaguucaccaaggaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100096 - RNA, 1701 nt, Artificial Sequence; identical to SEQ ID NO: 100095
  derived and/or modified sequence opt2 from hemagglutinin__InfluenzaA__AFG99446

SEQ ID NO: 100097 - RNA, 1701 nt, Artificial Sequence
  derived and/or modified sequence opt2 from hemagglutinin__InfluenzaA__AFG99457
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgaccagaccucccucuacguccgcgccuccggccgcgucaccgucuccaccaagcgcucccagcagaccgucauccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100098 - RNA, 1701 nt, Artificial Sequence
  derived and/or modified sequence opt2 from hemagglutinin__InfluenzaA__AFG99468
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauggacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100099 - RNA, 1701 nt, Artificial Sequence
  derived and/or modified sequence opt2 from hemagglutinin__InfluenzaA__AFG99490
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucaucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100100 - RNA, 1701 nt, Artificial Sequence
  derived and/or modified sequence opt2 from hemagglutinin__InfluenzaA__AFG99501
augaagaccaucaucgcccucuccuacaucuucugccucgucgucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacaccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100101 - RNA, 1701 nt, Artificial Sequence
  derived and/or modified sequence opt2 from hemagglutinin__InfluenzaA__AFG99512
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100102 - RNA, 1701 nt, Artificial Sequence
  derived and/or modified sequence opt2 from hemagglutinin__InfluenzaA__AFG99523
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgagucccaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100103 - RNA, 1701 nt, Artificial Sequence; identical to SEQ ID NO: 99999
  derived and/or modified sequence opt2 from hemagglutinin__InfluenzaA__AFG99534

SEQ ID NO: 100104 - RNA, 1701 nt, Artificial Sequence; identical to SEQ ID NO: 99999
  derived and/or modified sequence opt2 from hemagglutinin__InfluenzaA__AFG99545

SEQ ID NO: 100105 - RNA, 1701 nt, Artificial Sequence
  derived and/or modified sequence opt2 from hemagglutinin__InfluenzaA__AFG99556
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccgcaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100106 - RNA, 1701 nt, Artificial Sequence; identical to SEQ ID NO: 99999
  derived and/or modified sequence opt2 from hemagglutinin__InfluenzaA__AFG99567

SEQ ID NO: 100107 - RNA, 1701 nt, Artificial Sequence; identical to SEQ ID NO: 99999
  derived and/or modified sequence opt2 from hemagglutinin__InfluenzaA__AFG99578

SEQ ID NO: 100108 - RNA, 1701 nt, Artificial Sequence; identical to SEQ ID NO: 99999
  derived and/or modified sequence opt2 from hemagglutinin__InfluenzaA__AFG99589

SEQ ID NO: 100109 - RNA, 1701 nt, Artificial Sequence
  derived and/or modified sequence opt2 from hemagglutinin__InfluenzaA__AFG99600
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcguccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaucggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100110 - RNA, 1701 nt, Artificial Sequence; identical to SEQ ID NO: 99999
  derived and/or modified sequence opt2 from hemagglutinin__InfluenzaA__AFG99611

SEQ ID NO: 100111 - RNA, 1701 nt, Artificial Sequence; identical to SEQ ID NO: 99999
  derived and/or modified sequence opt2 from hemagglutinin__InfluenzaA__AFG99622

SEQ ID NO: 100112 - RNA, 1701 nt, Artificial Sequence; identical to SEQ ID NO: 99999
  derived and/or modified sequence opt2 from hemagglutinin__InfluenzaA__AFG99633

SEQ ID NO: 100113 - RNA, 1701 nt, Artificial Sequence
  derived and/or modified sequence opt2 from hemagglutinin__InfluenzaA__AFG99644
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccgccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgagaucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100114 - RNA, 1701 nt, Artificial Sequence
  derived and/or modified sequence opt2 from hemagglutinin__InfluenzaA__AFG99655
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100115 - RNA, 1701 nt, Artificial Sequence; identical to SEQ ID NO: 100114
  derived and/or modified sequence opt2 from hemagglutinin__InfluenzaA__AFG99666

SEQ ID NO: 100116 - RNA, 1701 nt, Artificial Sequence; identical to SEQ ID NO: 93850
  derived and/or modified sequence opt2 from hemagglutinin__InfluenzaA__AFG99677

SEQ ID NO: 100117 - RNA, 1701 nt, Artificial Sequence; identical to SEQ ID NO: 99999
  derived and/or modified sequence opt2 from hemagglutinin__InfluenzaA__AFG99688

SEQ ID NO: 100118 - RNA, 1701 nt, Artificial Sequence
  derived and/or modified sequence opt2 from hemagglutinin__InfluenzaA__AFG99701
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaacgccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgccgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100119 - RNA, 1701 nt, Artificial Sequence
  derived and/or modified sequence opt2 from hemagglutinin__InfluenzaA__AFG99712
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgagguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100120 - RNA, 1701 nt, Artificial Sequence; identical to SEQ ID NO: 99999
  derived and/or modified sequence opt2 from hemagglutinin__InfluenzaA__AFG99723

SEQ ID NO: 100121 - RNA, 1701 nt, Artificial Sequence; identical to SEQ ID NO: 100114
  derived and/or modified sequence opt2 from hemagglutinin__InfluenzaA__AFG99734

SEQ ID NO: 100122 - RNA, 1701 nt, Artificial Sequence
  derived and/or modified sequence opt2 from hemagglutinin__InfluenzaA__AFG99745
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgagcgcgagcagaccucccucuacauccgcgccuccggccgcgucaccgucuccaccaagcgcucccagcagaccgucauccccaacaucggcuccaagcccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaugggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100123 - RNA, 1701 nt, Artificial Sequence; identical to SEQ ID NO: 99999
  derived and/or modified sequence opt2 from hemagglutinin__InfluenzaA__AFG99756

SEQ ID NO: 100124 - RNA, 1701 nt, Artificial Sequence
  derived and/or modified sequence opt2 from hemagglutinin__InfluenzaA__AFG99767
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100125 - RNA, 1701 nt, Artificial Sequence
  derived and/or modified sequence opt2 from hemagglutinin__InfluenzaA__AFG99778
augaagaccaucaucgcccucuccuacauccucugccucgucuucgcccagaagcuccccggcaacgacaacuccaccgccacccucugccucggccaccacgccguccccaacggcacccucgucaagacccucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacggccuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaaguccgaguacaaguaccccgcccucaacgucaccaugcccaacaacggcaaggucgacaagcucuacaucuggggcguccaccaccccuccaccgaccgcgaccagaccucccucuacguccgcgccuccggccgcgucaccgucuccaccaagcgcucccagcagaccgucauccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100126 - RNA, 1701 nt, Artificial Sequence; identical to SEQ ID NO: 99999
  derived and/or modified sequence opt2 from hemagglutinin__InfluenzaA__AFG99789

SEQ ID NO: 100127 - RNA, 1701 nt, Artificial Sequence; identical to SEQ ID NO: 100114
  derived and/or modified sequence opt2 from hemagglutinin__InfluenzaA__AFG99800

SEQ ID NO: 100128 - RNA, 1701 nt, Artificial Sequence
  derived and/or modified sequence opt2 from hemagglutinin__InfluenzaA__AFG99811
augaagaccaucaucgcccucuccuacauccucugccucgucuucucccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100129 - RNA, 1701 nt, Artificial Sequence; identical to SEQ ID NO: 99999
  derived and/or modified sequence opt2 from hemagglutinin__InfluenzaA__AFG99822

SEQ ID NO: 100130 - RNA, 1701 nt, Artificial Sequence; identical to SEQ ID NO: 99999
  derived and/or modified sequence opt2 from hemagglutinin__InfluenzaA__AFG99833

SEQ ID NO: 100131 - RNA, 1701 nt, Artificial Sequence; identical to SEQ ID NO: 99999
  derived and/or modified sequence opt2 from hemagglutinin__InfluenzaA__AFG99844

SEQ ID NO: 100132 - RNA, 1701 nt, Artificial Sequence
  derived and/or modified sequence opt2 from hemagglutinin__InfluenzaA__AFG99855
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccggcaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100133 - RNA, 1701 nt, Artificial Sequence; identical to SEQ ID NO: 99999
  derived and/or modified sequence opt2 from hemagglutinin__InfluenzaA__AFG99866

SEQ ID NO: 100134 - RNA, 1701 nt, Artificial Sequence; identical to SEQ ID NO: 99999
  derived and/or modified sequence opt2 from hemagglutinin__InfluenzaA__AFG99877

SEQ ID NO: 100135 - RNA, 1701 nt, Artificial Sequence
  derived and/or modified sequence opt2 from hemagglutinin__InfluenzaA__AFG99888
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100136 - RNA, 1701 nt, Artificial Sequence; identical to SEQ ID NO: 99999
  derived and/or modified sequence opt2 from hemagglutinin__InfluenzaA__AFG99899

SEQ ID NO: 100137 - RNA, 1701 nt, Artificial Sequence; identical to SEQ ID NO: 99999
  derived and/or modified sequence opt2 from hemagglutinin__InfluenzaA__AFG99910

SEQ ID NO: 100138 - RNA, 1701 nt, Artificial Sequence; identical to SEQ ID NO: 99999
  derived and/or modified sequence opt2 from hemagglutinin__InfluenzaA__AFG99921

SEQ ID NO: 100139 - RNA, 1701 nt, Artificial Sequence
  derived and/or modified sequence opt2 from hemagglutinin__InfluenzaA__AFG99932
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100140 - RNA, 1701 nt, Artificial Sequence; identical to SEQ ID NO: 99999
  derived and/or modified sequence opt2 from hemagglutinin__InfluenzaA__AFG99943

SEQ ID NO: 100141 - RNA, 1701 nt, Artificial Sequence
  derived and/or modified sequence opt2 from hemagglutinin__InfluenzaA__AFG99954
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgagcgcgagcagaccucccucuacauccgcgccuccggccgcgucaccgucuccaccaagcgcucccagcagaccgucauccccaacaucggcuucaagcccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100142 - RNA, 1701 nt, Artificial Sequence
  derived and/or modified sequence opt2 from hemagglutinin__InfluenzaA__AFG99965
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaguccggcgaguccuacgccugcaagcgcggcuccgucaaguccuucuucucccgccucaacuggcuccacgaguccgacuacaaguaccccgcccucaacgucaccaugcccaacaacggcaaguucgacaagcucuacaucuggggcguccaccaccccuccaccgaccgcgagcagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100143 - RNA, 1701 nt, Artificial Sequence; identical to SEQ ID NO: 99999
  derived and/or modified sequence opt2 from hemagglutinin__InfluenzaA__AFG99976

SEQ ID NO: 100144 - RNA, 1701 nt, Artificial Sequence
  derived and/or modified sequence opt2 from hemagglutinin__InfluenzaA__AFG99987
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccagaacggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100145 - RNA, 1701 nt, Artificial Sequence
  derived and/or modified sequence opt2 from hemagglutinin__InfluenzaA__AFG99998
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100146 - RNA, 1701 nt, Artificial Sequence; identical to SEQ ID NO: 100114
  derived and/or modified sequence opt2 from hemagglutinin__InfluenzaA__AFH00021

SEQ ID NO: 100147 - RNA, 1701 nt, Artificial Sequence
  derived and/or modified sequence opt2 from hemagglutinin__InfluenzaA__AFH00032
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100148 - RNA, 1701 nt, Artificial Sequence
  derived and/or modified sequence opt2 from hemagglutinin__InfluenzaA__AFH00043
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgccaccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100149 - RNA, 1701 nt, Artificial Sequence
  derived and/or modified sequence opt2 from hemagglutinin__InfluenzaA__AFH00054
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccagaacggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100150 - RNA, 1701 nt, Artificial Sequence
  derived and/or modified sequence opt2 from hemagglutinin__InfluenzaA__AFH00065
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccagcccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100151 - RNA, 1701 nt, Artificial Sequence
  derived and/or modified sequence opt2 from hemagglutinin__InfluenzaA__AFH00076
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100152 - RNA, 1701 nt, Artificial Sequence
  derived and/or modified sequence opt2 from hemagglutinin__InfluenzaA__AFH00087
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccgaggccuacuccuccugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccaguccucccgcaucggcaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100153 - RNA, 1701 nt, Artificial Sequence
  derived and/or modified sequence opt2 from hemagglutinin__InfluenzaA__AFH00098
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccuccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100154 - RNA, 1701 nt, Artificial Sequence
  derived and/or modified sequence opt2 from hemagglutinin__InfluenzaA__AFH00109
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacaccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100155 - RNA, 1701 nt, Artificial Sequence
  derived and/or modified sequence opt2 from hemagglutinin__InfluenzaA__AFH00120
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaccaugugggccugccagaagggcaacauccgcugcaacaucugcaucuga

SEQ ID NO: 100156 - RNA, 1701 nt, Artificial Sequence; identical to SEQ ID NO: 100010
  derived and/or modified sequence opt2 from hemagglutinin__InfluenzaA__AFH00131

SEQ ID NO: 100157 - RNA, 1701 nt, Artificial Sequence
  derived and/or modified sequence opt2 from hemagglutinin__InfluenzaA__AFH00153
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100158 - RNA, 1701 nt, Artificial Sequence
  derived and/or modified sequence opt2 from hemagglutinin__InfluenzaA__AFH00164
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucauggacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccagaacggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100159 - RNA, 1701 nt, Artificial Sequence
  derived and/or modified sequence opt2 from hemagglutinin__InfluenzaA__AFH00175
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagaagucccagcagaccgucauccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100160 - RNA, 1701 nt, Artificial Sequence
  derived and/or modified sequence opt2 from hemagglutinin__InfluenzaA__AFH00186
augaagaccaucaucgcccucucccacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccaguccucccgcaucuccaucuacuggaccaucgucaagcccggcgacauccuccucaucuccuccaccggcaaccucaucgccccccgcggcuacuucaagauccgcaacggcaaguccuccaucaugcgcuccgacguccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcucaucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100161 - RNA, 1701 nt, Artificial Sequence
  derived and/or modified sequence opt2 from hemagglutinin__InfluenzaA__AFH00197
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacaccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagaucucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100162 - RNA, 1701 nt, Artificial Sequence
  derived and/or modified sequence opt2 from hemagglutinin__InfluenzaA__AFH00208
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccagaacggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccgucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucucccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100163 - RNA, 1701 nt, Artificial Sequence
  derived and/or modified sequence opt2 from hemagglutinin__InfluenzaA__AFH00219
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgaccccaacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgacaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100164 - RNA, 1701 nt, Artificial Sequence
  derived and/or modified sequence opt2 from hemagglutinin__InfluenzaA__AFH00230
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacggcaaguucgacaagcucuacaucuggggcguccaccaccccuccaccaacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100165 - RNA, 1701 nt, Artificial Sequence; identical to SEQ ID NO: 92536
  derived and/or modified sequence opt2 from hemagglutinin__InfluenzaA__AFH00241

SEQ ID NO: 100166 - RNA, 1701 nt, Artificial Sequence
  derived and/or modified sequence opt2 from hemagglutinin__InfluenzaA__AFH00252
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgacuccuacgccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100167 - RNA, 1701 nt, Artificial Sequence
  derived and/or modified sequence opt2 from hemagglutinin__InfluenzaA__AFH00263
augaagaccaucaucgcccucuccuacauccuccaccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgaccccaacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccguccagaccucccucuacguccgcgccuccggcaaggucaccgucuccaccaagcgcucccagcagaccgucacccccaacaucggcuccaagcccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100168 - RNA, 1701 nt, Artificial Sequence
  derived and/or modified sequence opt2 from hemagglutinin__InfluenzaA__AFH00274
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccuccggcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100169 - RNA, 1701 nt, Artificial Sequence
  derived and/or modified sequence opt2 from hemagglutinin__InfluenzaA__AFH00285
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcggcuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100170 - RNA, 1701 nt, Artificial Sequence
  derived and/or modified sequence opt2 from hemagglutinin__InfluenzaA__AFH00296
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 100171 - RNA, 1701 nt, Artificial Sequence
  derived and/or modified sequence opt2 from hemagglutinin__InfluenzaA__AFH00307
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100172 - RNA, 1701 nt, Artificial Sequence; identical to SEQ ID NO: 100171
  derived and/or modified sequence opt2 from hemagglutinin__InfluenzaA__AFH00318

SEQ ID NO: 100173 - RNA, 1701 nt, Artificial Sequence
  derived and/or modified sequence opt2 from hemagglutinin__InfluenzaA__AFH00329
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacucccaccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccuccaucuacguccgcgccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 100174 - RNA, 1701 nt, Artificial Sequence
  derived and/or modified sequence opt2 from hemagglutinin__InfluenzaA__AFH00340
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100175 - RNA, 1701 nt, Artificial Sequence
  derived and/or modified sequence opt2 from hemagglutinin__InfluenzaA__AFH00351
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccgacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacaagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100176 - RNA, 1701 nt, Artificial Sequence
  derived and/or modified sequence opt2 from hemagglutinin__InfluenzaA__AFH00362
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 100177 - RNA, 1701 nt, Artificial Sequence
  derived and/or modified sequence opt2 from hemagglutinin__InfluenzaA__AFH00384
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaucggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100178 - RNA, 1701 nt, Artificial Sequence
  derived and/or modified sequence opt2 from hemagglutinin__InfluenzaA__AFH00395
augaaggccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacggcuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaaguccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100179 - RNA, 1701 nt, Artificial Sequence
  derived and/or modified sequence opt2 from hemagglutinin__InfluenzaA__AFH00417
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100180 - RNA, 1701 nt, Artificial Sequence; identical to SEQ ID NO: 92500
  derived and/or modified sequence opt2 from hemagglutinin__InfluenzaA__AFH00428

SEQ ID NO: 100181 - RNA, 1701 nt, Artificial Sequence
  derived and/or modified sequence opt2 from hemagglutinin__InfluenzaA__AFH00439
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100182 - RNA, 1701 nt, Artificial Sequence
  derived and/or modified sequence opt2 from hemagglutinin__InfluenzaA__AFH00450
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacggcccccaccgcaucaucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaguccuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaguccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100183 - RNA, 1701 nt, Artificial Sequence
  derived and/or modified sequence opt2 from hemagglutinin__InfluenzaA__AFH00461
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgacuacaaguaccccgcccucaacgucaccaugcccaacaacggcaaguucgacaagcucuacaucuggggcguccaccaccccuccaccgacuccgaccagaucucccucuacguccgcuccuccggccgcgucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagcuccgcaacggcaaguccuccaucaugcgcuccgacgcccccaucggcaacugcuccuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100184 - RNA, 1701 nt, Artificial Sequence
  derived and/or modified sequence opt2 from hemagglutinin__InfluenzaA__AFH00472
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacgucuccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100185 - RNA, 1701 nt, Artificial Sequence
  derived and/or modified sequence opt2 from hemagglutinin__InfluenzaA__AFH00483
augaagaccaucaucgcccucuccuacauccucugcauggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100186 - RNA, 1701 nt, Artificial Sequence
  derived and/or modified sequence opt2 from hemagglutinin__InfluenzaA__AFH00494
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccgacaucggcuaccgccccuggguccgcggccaguccucccgcaucggcaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100187 - RNA, 1701 nt, Artificial Sequence
  derived and/or modified sequence opt2 from hemagglutinin__InfluenzaA__AFH00505
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaucucccucuacguccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100188 - RNA, 1701 nt, Artificial Sequence
  derived and/or modified sequence opt2 from hemagglutinin__InfluenzaA__AFH00516
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaaguccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100189 - RNA, 1701 nt, Artificial Sequence
  derived and/or modified sequence opt2 from hemagglutinin__InfluenzaA__AFH00527
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccauccacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100190 - RNA, 1701 nt, Artificial Sequence
  derived and/or modified sequence opt2 from hemagglutinin__InfluenzaA__AFH00538
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccagcgcuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100191 - RNA, 1701 nt, Artificial Sequence
  derived and/or modified sequence opt2 from hemagglutinin__InfluenzaA__AFH00549
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggcccccggccgcgucaccgucuccacccgccgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucuccaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100192 - RNA, 1701 nt, Artificial Sequence
  derived and/or modified sequence opt2 from hemagglutinin__InfluenzaA__AFH00560
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacaucccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggccgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100193 - RNA, 1701 nt, Artificial Sequence
  derived and/or modified sequence opt2 from hemagglutinin__InfluenzaA__AFH00571
augaagaccaucaucgcccucuccuacauccucugccucgucuucgcccagaagcuccccgucaacgacaacuccaccgccacccucugccucggccaccacgccguccccaacggcacccucgucaagaccaucaccaacgacaacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100194 - RNA, 1701 nt, Artificial Sequence
  derived and/or modified sequence opt2 from hemagglutinin__InfluenzaA__AFH00582
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 100195 - RNA, 1701 nt, Artificial Sequence; identical to SEQ ID NO: 92817
  derived and/or modified sequence opt2 from hemagglutinin__InfluenzaA__AFH00593

SEQ ID NO: 100196 - RNA, 1701 nt, Artificial Sequence; identical to SEQ ID NO: 92817
  derived and/or modified sequence opt2 from hemagglutinin__InfluenzaA__AFH00604

SEQ ID NO: 100197 - RNA, 1701 nt, Artificial Sequence
  derived and/or modified sequence opt2 from hemagglutinin__InfluenzaA__AFH00615
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100198 - RNA, 1701 nt, Artificial Sequence; identical to SEQ ID NO: 99789
  derived and/or modified sequence opt2 from hemagglutinin__InfluenzaA__AFH00626

SEQ ID NO: 100199 - RNA, 1701 nt, Artificial Sequence
  derived and/or modified sequence opt2 from hemagglutinin__InfluenzaA__AFH00637
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacacccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100200 - RNA, 1701 nt, Artificial Sequence
  derived and/or modified sequence opt2 from hemagglutinin__InfluenzaA__AFH00648
augaagaccaucaucgcccucuccuacauccucugccucgucuucgcccagaagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100201 - RNA, 1701 nt, Artificial Sequence
  derived and/or modified sequence opt2 from hemagglutinin__InfluenzaA__AFH00659
augaagaccaucaucgcccucuccuacauccucugccucgucuucacccagaagcuccccggcaacgacaacuccaccgccacccucugccucggccaccacgccguccccaacggcaccauggucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccgacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100202 - RNA, 1701 nt, Artificial Sequence
  derived and/or modified sequence opt2 from hemagglutinin__InfluenzaA__AFH00670
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccuccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100203 - RNA, 1701 nt, Artificial Sequence
  derived and/or modified sequence opt2 from hemagglutinin__InfluenzaA__AFH00681
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaaggagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100204 - RNA, 1701 nt, Artificial Sequence; identical to SEQ ID NO: 93440
  derived and/or modified sequence opt2 from hemagglutinin__InfluenzaA__AFH00692

SEQ ID NO: 100205 - RNA, 1701 nt, Artificial Sequence
  derived and/or modified sequence opt2 from hemagglutinin__InfluenzaA__AFH00703
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcaagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguacuccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagaugcaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100206 - RNA, 1701 nt, Artificial Sequence
  derived and/or modified sequence opt2 from hemagglutinin__InfluenzaA__AFH00714
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgacaaguccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccuccggcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100207 - RNA, 1701 nt, Artificial Sequence
  derived and/or modified sequence opt2 from hemagglutinin__InfluenzaA__AFH00725
augaagaccaucaucgcccucuccuacaucuucugccucaucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaagcucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100208 - RNA, 1701 nt, Artificial Sequence; identical to SEQ ID NO: 98578
  derived and/or modified sequence opt2 from hemagglutinin__InfluenzaA__AFH00736

SEQ ID NO: 100209 - RNA, 1701 nt, Artificial Sequence
  derived and/or modified sequence opt2 from hemagglutinin__InfluenzaA__AFH00747
augaagaccaucaucgcccucuccuacaucuucugccucgucuucgcccagaagcuccccggcaacgacaacuccaccgccacccucugccucggccacuacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100210 - RNA, 1701 nt, Artificial Sequence
  derived and/or modified sequence opt2 from hemagglutinin__InfluenzaA__AFH00758
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaagcucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100211 - RNA, 1701 nt, Artificial Sequence
  derived and/or modified sequence opt2 from hemagglutinin__InfluenzaA__AFH00769
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacaccugcaagcgcggcuccgucaaguccuucuucucccgccucaacuggcuccacgaguccgaguacaaguaccccgcccucaacgucaccaugcccaacaacgacaaguucgacaagcucuacaucuggggcguccaccaccccuccaccgaccgcgagcagaccucccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100212 - RNA, 1701 nt, Artificial Sequence
  derived and/or modified sequence opt2 from hemagglutinin__InfluenzaA__AFH00780
augcgcgccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100213 - RNA, 1701 nt, Artificial Sequence
  derived and/or modified sequence opt2 from hemagglutinin__InfluenzaA__AFH00791
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagggcuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacaccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100214 - RNA, 1701 nt, Artificial Sequence; identical to SEQ ID NO: 92854
  derived and/or modified sequence opt2 from hemagglutinin__InfluenzaA__AFH00802

SEQ ID NO: 100215 - RNA, 1701 nt, Artificial Sequence
  derived and/or modified sequence opt2 from hemagglutinin__InfluenzaA__AFH00813
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcgacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100216 - RNA, 1701 nt, Artificial Sequence
  derived and/or modified sequence opt2 from hemagglutinin__InfluenzaA__AFH00824
augaagaccaucaucgcccucuccuacauccuccgccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100217 - RNA, 1701 nt, Artificial Sequence
  derived and/or modified sequence opt2 from hemagglutinin__InfluenzaA__AFH01407
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100218 - RNA, 1701 nt, Artificial Sequence
  derived and/or modified sequence opt2 from hemagglutinin__InfluenzaA__AFH34940
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccggcuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100219 - RNA, 1701 nt, Artificial Sequence
  derived and/or modified sequence opt2 from hemagglutinin__InfluenzaA__AFH34961
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccgccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100220 - RNA, 1701 nt, Artificial Sequence
  derived and/or modified sequence opt2 from hemagglutinin__InfluenzaA__AFH34968
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccgccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100221 - RNA, 1701 nt, Artificial Sequence
  derived and/or modified sequence opt2 from hemagglutinin__InfluenzaA__AFH34975
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaacggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100222 - RNA, 1701 nt, Artificial Sequence; identical to SEQ ID NO: 94923
  derived and/or modified sequence opt2 from hemagglutinin__InfluenzaA__AFH74464

SEQ ID NO: 100223 - RNA, 1701 nt, Artificial Sequence; identical to SEQ ID NO: 94181
  derived and/or modified sequence opt2 from hemagglutinin__InfluenzaA__AFH74465

SEQ ID NO: 100224 - RNA, 1701 nt, Artificial Sequence; identical to SEQ ID NO: 94942
  derived and/or modified sequence opt2 from hemagglutinin__InfluenzaA__AFH74477

SEQ ID NO: 100225 - RNA, 1701 nt, Artificial Sequence
  derived and/or modified sequence opt2 from hemagglutinin__InfluenzaA__AFH74488
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacaacccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100226 - RNA, 1701 nt, Artificial Sequence; identical to SEQ ID NO: 94923
  derived and/or modified sequence opt2 from hemagglutinin__InfluenzaA__AFH74499

SEQ ID NO: 100227 - RNA, 1701 nt, Artificial Sequence; identical to SEQ ID NO: 95125
  derived and/or modified sequence opt2 from hemagglutinin__InfluenzaA__AFH74510

SEQ ID NO: 100228 - RNA, 1701 nt, Artificial Sequence
  derived and/or modified sequence opt2 from hemagglutinin__InfluenzaA__AFH74521
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguccaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100229 - RNA, 1701 nt, Artificial Sequence; identical to SEQ ID NO: 98500
  derived and/or modified sequence opt2 from hemagglutinin__InfluenzaA__AFH74532

SEQ ID NO: 100230 - RNA, 1701 nt, Artificial Sequence; identical to SEQ ID NO: 95125
  derived and/or modified sequence opt2 from hemagglutinin__InfluenzaA__AFH74543

SEQ ID NO: 100231 - RNA, 1701 nt, Artificial Sequence; identical to SEQ ID NO: 95125
  derived and/or modified sequence opt2 from hemagglutinin__InfluenzaA__AFH74554

SEQ ID NO: 100232 - RNA, 1701 nt, Artificial Sequence; identical to SEQ ID NO: 95125
  derived and/or modified sequence opt2 from hemagglutinin__InfluenzaA__AFH74565

SEQ ID NO: 100233 - RNA, 1701 nt, Artificial Sequence; identical to SEQ ID NO: 95125
  derived and/or modified sequence opt2 from hemagglutinin__InfluenzaA__AFH74576

SEQ ID NO: 100234 - RNA, 1701 nt, Artificial Sequence; identical to SEQ ID NO: 95125
  derived and/or modified sequence opt2 from hemagglutinin__InfluenzaA__AFH74587

SEQ ID NO: 100235 - RNA, 1701 nt, Artificial Sequence
  derived and/or modified sequence opt2 from hemagglutinin__InfluenzaA__AFH74598
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100236 - RNA, 1701 nt, Artificial Sequence; identical to SEQ ID NO: 94923
  derived and/or modified sequence opt2 from hemagglutinin__InfluenzaA__AFH74609

SEQ ID NO: 100237 - RNA, 1701 nt, Artificial Sequence; identical to SEQ ID NO: 95125
  derived and/or modified sequence opt2 from hemagglutinin__InfluenzaA__AFH74620

SEQ ID NO: 100238 - RNA, 1701 nt, Artificial Sequence
  derived and/or modified sequence opt2 from hemagglutinin__InfluenzaA__AFH74631
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaccaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100239 - RNA, 1701 nt, Artificial Sequence; identical to SEQ ID NO: 94923
  derived and/or modified sequence opt2 from hemagglutinin__InfluenzaA__AFH74642

SEQ ID NO: 100240 - RNA, 1701 nt, Artificial Sequence; identical to SEQ ID NO: 94923
  derived and/or modified sequence opt2 from hemagglutinin__InfluenzaA__AFH74653

SEQ ID NO: 100241 - RNA, 1701 nt, Artificial Sequence; identical to SEQ ID NO: 94923
  derived and/or modified sequence opt2 from hemagglutinin__InfluenzaA__AFH74664

SEQ ID NO: 100242 - RNA, 1701 nt, Artificial Sequence; identical to SEQ ID NO: 94923
  derived and/or modified sequence opt2 from hemagglutinin__InfluenzaA__AFH74675

SEQ ID NO: 100243 - RNA, 1701 nt, Artificial Sequence; identical to SEQ ID NO: 99671
  derived and/or modified sequence opt2 from hemagglutinin__InfluenzaA__AFH74686

SEQ ID NO: 100244 - RNA, 1701 nt, Artificial Sequence; identical to SEQ ID NO: 99671
  derived and/or modified sequence opt2 from hemagglutinin__InfluenzaA__AFH74697

SEQ ID NO: 100245 - RNA, 1701 nt, Artificial Sequence; identical to SEQ ID NO: 95125
  derived and/or modified sequence opt2 from hemagglutinin__InfluenzaA__AFH74708

SEQ ID NO: 100246 - RNA, 1701 nt, Artificial Sequence; identical to SEQ ID NO: 95125
  derived and/or modified sequence opt2 from hemagglutinin__InfluenzaA__AFH74719

SEQ ID NO: 100247 - RNA, 1701 nt, Artificial Sequence; identical to SEQ ID NO: 95125
  derived and/or modified sequence opt2 from hemagglutinin__InfluenzaA__AFH74730

SEQ ID NO: 100248 - RNA, 1701 nt, Artificial Sequence
  derived and/or modified sequence opt2 from hemagglutinin__InfluenzaA__AFH74741
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100249 - RNA, 1701 nt, Artificial Sequence; identical to SEQ ID NO: 95125
  derived and/or modified sequence opt2 from hemagglutinin__InfluenzaA__AFH74752

SEQ ID NO: 100250 - RNA, 1701 nt, Artificial Sequence; identical to SEQ ID NO: 95125
  derived and/or modified sequence opt2 from hemagglutinin__InfluenzaA__AFH74763

SEQ ID NO: 100251 - RNA, 1701 nt, Artificial Sequence; identical to SEQ ID NO: 95125
  derived and/or modified sequence opt2 from hemagglutinin__InfluenzaA__AFH74774

SEQ ID NO: 100252 - RNA, 1701 nt, Artificial Sequence; identical to SEQ ID NO: 98500
  derived and/or modified sequence opt2 from hemagglutinin__InfluenzaA__AFH74785

SEQ ID NO: 100253 - RNA, 1701 nt, Artificial Sequence; identical to SEQ ID NO: 95125
  derived and/or modified sequence opt2 from hemagglutinin__InfluenzaA__AFH74796

SEQ ID NO: 100254 - RNA, 1701 nt, Artificial Sequence; identical to SEQ ID NO: 99681
  derived and/or modified sequence opt2 from hemagglutinin__InfluenzaA__AFH74807

SEQ ID NO: 100255 - RNA, 1701 nt, Artificial Sequence; identical to SEQ ID NO: 99681
  derived and/or modified sequence opt2 from hemagglutinin__InfluenzaA__AFH74818

SEQ ID NO: 100256 - RNA, 1701 nt, Artificial Sequence; identical to SEQ ID NO: 99681
  derived and/or modified sequence opt2 from hemagglutinin__InfluenzaA__AFH74829

SEQ ID NO: 100257 - RNA, 1701 nt, Artificial Sequence; identical to SEQ ID NO: 99681
  derived and/or modified sequence opt2 from hemagglutinin__InfluenzaA__AFH74840

SEQ ID NO: 100258 - RNA, 1701 nt, Artificial Sequence
  derived and/or modified sequence opt2 from hemagglutinin__InfluenzaA__AFH74851
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacggcaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccuccgccucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100259 - RNA, 1701 nt, Artificial Sequence; identical to SEQ ID NO: 99684
  derived and/or modified sequence opt2 from hemagglutinin__InfluenzaA__AFH74862

SEQ ID NO: 100260 - RNA, 1701 nt, Artificial Sequence; identical to SEQ ID NO: 99684
  derived and/or modified sequence opt2 from hemagglutinin__InfluenzaA__AFH74873

SEQ ID NO: 100261 - RNA, 1701 nt, Artificial Sequence; identical to SEQ ID NO: 95125
  derived and/or modified sequence opt2 from hemagglutinin__InfluenzaA__AFH74884

SEQ ID NO: 100262 - RNA, 1701 nt, Artificial Sequence; identical to SEQ ID NO: 95125
  derived and/or modified sequence opt2 from hemagglutinin__InfluenzaA__AFH74895

SEQ ID NO: 100263 - RNA, 1701 nt, Artificial Sequence; identical to SEQ ID NO: 95125
  derived and/or modified sequence opt2 from hemagglutinin__InfluenzaA__AFH74906

SEQ ID NO: 100264 - RNA, 1701 nt, Artificial Sequence; identical to SEQ ID NO: 94923
  derived and/or modified sequence opt2 from hemagglutinin__InfluenzaA__AFH74917

SEQ ID NO: 100265 - RNA, 1701 nt, Artificial Sequence; identical to SEQ ID NO: 95125
  derived and/or modified sequence opt2 from hemagglutinin__InfluenzaA__AFH74928

SEQ ID NO: 100266 - RNA, 1701 nt, Artificial Sequence; identical to SEQ ID NO: 95125
  derived and/or modified sequence opt2 from hemagglutinin__InfluenzaA__AFH74939

SEQ ID NO: 100267 - RNA, 1701 nt, Artificial Sequence
  derived and/or modified sequence opt2 from hemagglutinin__InfluenzaA__AFH74950
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacggcaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100268 - RNA, 1701 nt, Artificial Sequence; identical to SEQ ID NO: 99684
  derived and/or modified sequence opt2 from hemagglutinin__InfluenzaA__AFH74961

SEQ ID NO: 100269 - RNA, 1701 nt, Artificial Sequence; identical to SEQ ID NO: 95125
  derived and/or modified sequence opt2 from hemagglutinin__InfluenzaA__AFH75388

SEQ ID NO: 100270 - RNA, 1701 nt, Artificial Sequence
  derived and/or modified sequence opt2 from hemagglutinin__InfluenzaA__AFH97140
augaaggccauccucgucguccuccucuacaucuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100271 - RNA, 1701 nt, Artificial Sequence
  derived and/or modified sequence opt2 from hemagglutinin__InfluenzaA__AFJ05142
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagugcuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100272 - RNA, 1701 nt, Artificial Sequence
  derived and/or modified sequence opt2 from hemagglutinin__InfluenzaA__AFJ05144
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100273 - RNA, 1701 nt, Artificial Sequence
  derived and/or modified sequence opt2 from hemagglutinin__InfluenzaA__AFJ11706
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcuccuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100274 - RNA, 1701 nt, Artificial Sequence; identical to SEQ ID NO: 98494
  derived and/or modified sequence opt2 from hemagglutinin__InfluenzaA__AFJ11728

SEQ ID NO: 100275 - RNA, 1701 nt, Artificial Sequence
  derived and/or modified sequence opt2 from hemagglutinin__InfluenzaA__AFJ19842
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100276 - RNA, 1701 nt, Artificial Sequence; identical to SEQ ID NO: 99873
  derived and/or modified sequence opt2 from hemagglutinin__InfluenzaA__AFJ20171

SEQ ID NO: 100277 - RNA, 1701 nt, Artificial Sequence; identical to SEQ ID NO: 98494
  derived and/or modified sequence opt2 from hemagglutinin__InfluenzaA__AFJ20182

SEQ ID NO: 100278 - RNA, 1701 nt, Artificial Sequence
  derived and/or modified sequence opt2 from hemagglutinin__InfluenzaA__AFJ74386
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucauguccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccggcgaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100279 - RNA, 1701 nt, Artificial Sequence
  derived and/or modified sequence opt2 from hemagglutinin__InfluenzaA__AFJ74407
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100280 - RNA, 1701 nt, Artificial Sequence
  derived and/or modified sequence opt2 from hemagglutinin__InfluenzaA__AFJ74418
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100281 - RNA, 1701 nt, Artificial Sequence
  derived and/or modified sequence opt2 from hemagglutinin__InfluenzaA__AFJ74437
augaagaccaucaucgcccucuccuacauccucugcaaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100282 - RNA, 1701 nt, Artificial Sequence
  derived and/or modified sequence opt2 from hemagglutinin__InfluenzaA__AFJ74448
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcggcccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100283 - RNA, 1701 nt, Artificial Sequence
  derived and/or modified sequence opt2 from hemagglutinin__InfluenzaA__AFJ74459
auggaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100284 - RNA, 1701 nt, Artificial Sequence
  derived and/or modified sequence opt2 from hemagglutinin__InfluenzaA__AFJ74470
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaucucccucuacgcccagaccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100285 - RNA, 1701 nt, Artificial Sequence
  derived and/or modified sequence opt2 from hemagglutinin__InfluenzaA__AFJ74492
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacaagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100286 - RNA, 1701 nt, Artificial Sequence
  derived and/or modified sequence opt2 from hemagglutinin__InfluenzaA__AFJ74525
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccaggacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100287 - RNA, 1701 nt, Artificial Sequence; identical to SEQ ID NO: 100285
  derived and/or modified sequence opt2 from hemagglutinin__InfluenzaA__AFJ74535

SEQ ID NO: 100288 - RNA, 1701 nt, Artificial Sequence
  derived and/or modified sequence opt2 from hemagglutinin__InfluenzaA__AFJ74560
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccagaccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100289 - RNA, 1701 nt, Artificial Sequence
  derived and/or modified sequence opt2 from hemagglutinin__InfluenzaA__AFJ74634
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100290 - RNA, 1698 nt, Artificial Sequence
  derived and/or modified sequence opt2 from hemagglutinin__InfluenzaA__AFJ74653
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgacaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100291 - RNA, 1698 nt, Artificial Sequence
  derived and/or modified sequence opt2 from hemagglutinin__InfluenzaA__AFJ74673
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccuccgcaaguccuacgccaacaacaaggagaaggagguccucguccucuggggcguccaccacccccccaacaucggcgaccagcgcgcccucuaccacaccgacaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100292 - RNA, 1701 nt, Artificial Sequence
  derived and/or modified sequence opt2 from hemagglutinin__InfluenzaA__AFJ74674
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagccccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100293 - RNA, 1698 nt, Artificial Sequence; identical to SEQ ID NO: 100290
  derived and/or modified sequence opt2 from hemagglutinin__InfluenzaA__AFJ74694

SEQ ID NO: 100294 - RNA, 1701 nt, Artificial Sequence
  derived and/or modified sequence opt2 from hemagglutinin__InfluenzaA__AFJ74695
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccaggacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccgcgccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 100295 - RNA, 1701 nt, Artificial Sequence
  derived and/or modified sequence opt2 from hemagglutinin__InfluenzaA__AFJ74727
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcuccggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100296 - RNA, 1698 nt, Artificial Sequence; identical to SEQ ID NO: 100290
  derived and/or modified sequence opt2 from hemagglutinin__InfluenzaA__AFJ74743

SEQ ID NO: 100297 - RNA, 1701 nt, Artificial Sequence; identical to SEQ ID NO: 100289
  derived and/or modified sequence opt2 from hemagglutinin__InfluenzaA__AFJ74744

SEQ ID NO: 100298 - RNA, 1698 nt, Artificial Sequence; identical to SEQ ID NO: 100290
  derived and/or modified sequence opt2 from hemagglutinin__InfluenzaA__AFJ74760

SEQ ID NO: 100299 - RNA, 1701 nt, Artificial Sequence
  derived and/or modified sequence opt2 from hemagglutinin__InfluenzaA__AFJ74761
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100300 - RNA, 1698 nt, Artificial Sequence; identical to SEQ ID NO: 100290
  derived and/or modified sequence opt2 from hemagglutinin__InfluenzaA__AFJ74779

SEQ ID NO: 100301 - RNA, 1701 nt, Artificial Sequence; identical to SEQ ID NO: 100289
  derived and/or modified sequence opt2 from hemagglutinin__InfluenzaA__AFJ74780

SEQ ID NO: 100302 - RNA, 1701 nt, Artificial Sequence
  derived and/or modified sequence opt2 from hemagglutinin__InfluenzaA__AFJ74804
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaaccgcaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100303 - RNA, 1701 nt, Artificial Sequence
  derived and/or modified sequence opt2 from hemagglutinin__InfluenzaA__AFJ74819
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucaaccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100304 - RNA, 1701 nt, Artificial Sequence; identical to SEQ ID NO: 94157
  derived and/or modified sequence opt2 from hemagglutinin__InfluenzaA__AFJ74842

SEQ ID NO: 100305 - RNA, 1698 nt, Artificial Sequence
  derived and/or modified sequence opt2 from hemagglutinin__InfluenzaA__AFJ75036
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggagaacuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100306 - RNA, 1701 nt, Artificial Sequence; identical to SEQ ID NO: 92142
  derived and/or modified sequence opt2 from hemagglutinin__InfluenzaA__AFJ75047

SEQ ID NO: 100307 - RNA, 1698 nt, Artificial Sequence
  derived and/or modified sequence opt2 from hemagglutinin__InfluenzaA__AFJ75058
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100308 - RNA, 1698 nt, Artificial Sequence
  derived and/or modified sequence opt2 from hemagglutinin__InfluenzaA__AFJ75069
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaaguccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100309 - RNA, 1701 nt, Artificial Sequence
  derived and/or modified sequence opt2 from hemagglutinin__InfluenzaA__AFJ75091
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagaucucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaccuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100310 - RNA, 1701 nt, Artificial Sequence
  derived and/or modified sequence opt2 from hemagglutinin__InfluenzaA__AFJ75449
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggcaagaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100311 - RNA, 1701 nt, Artificial Sequence
  derived and/or modified sequence opt2 from hemagglutinin__InfluenzaA__AFJ75460
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccgucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100312 - RNA, 1698 nt, Artificial Sequence
  derived and/or modified sequence opt2 from hemagglutinin__InfluenzaA__AFJ75517
augaaggucaagcuccucguccuccucugcaccuucaccgccaccuacgccgacaccaucugcaucggcuaccacgccaacaacuccaccgacaccgucgacaccguccucgagaagaacgucaccgucaccuacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaagaagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucaaccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100313 - RNA, 1698 nt, Artificial Sequence
  derived and/or modified sequence opt2 from hemagglutinin__InfluenzaA__AFJ75560
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguucguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100314 - RNA, 1698 nt, Artificial Sequence
  derived and/or modified sequence opt2 from hemagglutinin__InfluenzaA__AFJ75571
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100315 - RNA, 1701 nt, Artificial Sequence
  derived and/or modified sequence opt2 from hemagglutinin__InfluenzaA__AFJ75593
augaagaccaucaucgcccucuccuacauccucugccucgucuucgcccagaagcuccccggcaacgacuccuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100316 - RNA, 1698 nt, Artificial Sequence
  derived and/or modified sequence opt2 from hemagglutinin__InfluenzaA__AFJ75615
augaaggucaagcuccucguccuccucugcaccuucaccgccaccuacgccgacaccaucugcgucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgaggucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100317 - RNA, 1701 nt, Artificial Sequence; identical to SEQ ID NO: 96864
  derived and/or modified sequence opt2 from hemagglutinin__InfluenzaA__AFJ75630

SEQ ID NO: 100318 - RNA, 1701 nt, Artificial Sequence; identical to SEQ ID NO: 96864
  derived and/or modified sequence opt2 from hemagglutinin__InfluenzaA__AFJ75641

SEQ ID NO: 100319 - RNA, 1698 nt, Artificial Sequence
  derived and/or modified sequence opt2 from hemagglutinin__InfluenzaA__AFJ75651
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccgacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100320 - RNA, 1701 nt, Artificial Sequence
  derived and/or modified sequence opt2 from hemagglutinin__InfluenzaA__AFJ75662
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100321 - RNA, 1698 nt, Artificial Sequence
  derived and/or modified sequence opt2 from hemagglutinin__InfluenzaA__AFJ75673
augaaggucaagcuccucguccuccucugcaccuucaccgccaccuacgccgacaccaucugcaucggcuaccacgccaacaacuccaccgacaccgucgacaccguccucgagaagaacgucaccgucaccuacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucaaccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100322 - RNA, 1701 nt, Artificial Sequence; identical to SEQ ID NO: 94181
  derived and/or modified sequence opt2 from hemagglutinin__InfluenzaA__AFJ76119

SEQ ID NO: 100323 - RNA, 1701 nt, Artificial Sequence; identical to SEQ ID NO: 94534
  derived and/or modified sequence opt2 from hemagglutinin__InfluenzaA__AFJ76131

SEQ ID NO: 100324 - RNA, 1701 nt, Artificial Sequence
  derived and/or modified sequence opt2 from hemagglutinin__InfluenzaA__AFJ76155
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaaggccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100325 - RNA, 1698 nt, Artificial Sequence
  derived and/or modified sequence opt2 from hemagglutinin__InfluenzaA__AFJ76186
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucaccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccgacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100326 - RNA, 1701 nt, Artificial Sequence; identical to SEQ ID NO: 94181
  derived and/or modified sequence opt2 from hemagglutinin__InfluenzaA__AFJ76203

SEQ ID NO: 100327 - RNA, 1701 nt, Artificial Sequence
  derived and/or modified sequence opt2 from hemagglutinin__InfluenzaA__AFJ76213
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccacuccaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100328 - RNA, 1701 nt, Artificial Sequence
  derived and/or modified sequence opt2 from hemagglutinin__InfluenzaA__AFJ77408
augaagaccaucaucgcccucuccuacauccucugccucaucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100329 - RNA, 1701 nt, Artificial Sequence
  derived and/or modified sequence opt2 from hemagglutinin__InfluenzaA__AFJ77430
augaagaccaucaucgcccucuccuacauccucugccucaucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgaccccaacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100330 - RNA, 1701 nt, Artificial Sequence
  derived and/or modified sequence opt2 from hemagglutinin__InfluenzaA__AFJ77440
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccuccgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100331 - RNA, 1701 nt, Artificial Sequence
  derived and/or modified sequence opt2 from hemagglutinin__InfluenzaA__AFJ77451
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacggcaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100332 - RNA, 1701 nt, Artificial Sequence
  derived and/or modified sequence opt2 from hemagglutinin__InfluenzaA__AFJ77462
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100333 - RNA, 1701 nt, Artificial Sequence
  derived and/or modified sequence opt2 from hemagglutinin__InfluenzaA__AFJ77473
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100334 - RNA, 1701 nt, Artificial Sequence; identical to SEQ ID NO: 91698
  derived and/or modified sequence opt2 from hemagglutinin__InfluenzaA__AFJ77484

SEQ ID NO: 100335 - RNA, 1701 nt, Artificial Sequence; identical to SEQ ID NO: 91700
  derived and/or modified sequence opt2 from hemagglutinin__InfluenzaA__AFJ77495

SEQ ID NO: 100336 - RNA, 1701 nt, Artificial Sequence; identical to SEQ ID NO: 91698
  derived and/or modified sequence opt2 from hemagglutinin__InfluenzaA__AFJ77506

SEQ ID NO: 100337 - RNA, 1701 nt, Artificial Sequence
  derived and/or modified sequence opt2 from hemagglutinin__InfluenzaA__AFJ77517
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccaacgccugcaagcgccgcuccaugaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccacccagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 100338 - RNA, 1701 nt, Artificial Sequence; identical to SEQ ID NO: 91535
  derived and/or modified sequence opt2 from hemagglutinin__InfluenzaA__AFJ77528

SEQ ID NO: 100339 - RNA, 1698 nt, Artificial Sequence
  derived and/or modified sequence opt2 from hemagglutinin__InfluenzaA__AFJ77550
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 100340 - RNA, 1701 nt, Artificial Sequence
  derived and/or modified sequence opt2 from hemagglutinin__InfluenzaA__AFJ77561
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucuacuccaccggcaaccucaucgccccccgcggcuacuucaagauccgcuccggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100341 - RNA, 1698 nt, Artificial Sequence
  derived and/or modified sequence opt2 from hemagglutinin__InfluenzaA__AFJ77572
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 100342 - RNA, 1701 nt, Artificial Sequence
  derived and/or modified sequence opt2 from hemagglutinin__InfluenzaA__AFJ77583
augaagaccaucaucacccucuccuacauccucugccucgucuucgcccagaagcuccccgucaaggacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100343 - RNA, 1701 nt, Artificial Sequence
  derived and/or modified sequence opt2 from hemagglutinin__InfluenzaA__AFJ77594
augaagaccaucaucgcccucuccuacauccucugccucgucuucgcccagaagcuccccgucaaggacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100344 - RNA, 1701 nt, Artificial Sequence
  derived and/or modified sequence opt2 from hemagglutinin__InfluenzaA__AFJ77605
augaagaccaucaucgcccucuccuacauccucugccucaucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggccgucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100345 - RNA, 1701 nt, Artificial Sequence
  derived and/or modified sequence opt2 from hemagglutinin__InfluenzaA__AFJ77616
augaagaccaucaucgcccucuccuacauccucugcaugguccucgcccagaagcuccccgucaaggacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100346 - RNA, 1701 nt, Artificial Sequence
  derived and/or modified sequence opt2 from hemagglutinin__InfluenzaA__AFJ77627
augaagaccaucaucgcccucuccuacauccucugccucguccucgcccagaagcuccccgucaaggacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100347 - RNA, 1701 nt, Artificial Sequence
  derived and/or modified sequence opt2 from hemagglutinin__InfluenzaA__AFJ77638
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaccacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100348 - RNA, 1701 nt, Artificial Sequence
  derived and/or modified sequence opt2 from hemagglutinin__InfluenzaA__AFJ77649
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacaacaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100349 - RNA, 1701 nt, Artificial Sequence; identical to SEQ ID NO: 91715
  derived and/or modified sequence opt2 from hemagglutinin__InfluenzaA__AFJ77660

SEQ ID NO: 100350 - RNA, 1701 nt, Artificial Sequence; identical to SEQ ID NO: 91715
  derived and/or modified sequence opt2 from hemagglutinin__InfluenzaA__AFJ77671

SEQ ID NO: 100351 - RNA, 1701 nt, Artificial Sequence; identical to SEQ ID NO: 91715
  derived and/or modified sequence opt2 from hemagglutinin__InfluenzaA__AFJ77682

SEQ ID NO: 100352 - RNA, 1701 nt, Artificial Sequence
  derived and/or modified sequence opt2 from hemagglutinin__InfluenzaA__AFJ77693
augaagaccaucaucgcccucuccuacauccucugccucgucuucgcccagaagcuccccgucaacgacaacuccaccgccacccucugccucggccaccacaccguccccaacggcacccucgucaagaccaucaccaacgacaacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuucgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100353 - RNA, 1701 nt, Artificial Sequence; identical to SEQ ID NO: 91715
  derived and/or modified sequence opt2 from hemagglutinin__InfluenzaA__AFJ77704

SEQ ID NO: 100354 - RNA, 1701 nt, Artificial Sequence; identical to SEQ ID NO: 100193
  derived and/or modified sequence opt2 from hemagglutinin__InfluenzaA__AFJ77715

SEQ ID NO: 100355 - RNA, 1701 nt, Artificial Sequence; identical to SEQ ID NO: 100193
  derived and/or modified sequence opt2 from hemagglutinin__InfluenzaA__AFJ77726

SEQ ID NO: 100356 - RNA, 1701 nt, Artificial Sequence; identical to SEQ ID NO: 100289
  derived and/or modified sequence opt2 from hemagglutinin__InfluenzaA__AFJ77737

SEQ ID NO: 100357 - RNA, 1701 nt, Artificial Sequence; identical to SEQ ID NO: 91544
  derived and/or modified sequence opt2 from hemagglutinin__InfluenzaA__AFJ77748

SEQ ID NO: 100358 - RNA, 1701 nt, Artificial Sequence; identical to SEQ ID NO: 91544
  derived and/or modified sequence opt2 from hemagglutinin__InfluenzaA__AFJ77759

SEQ ID NO: 100359 - RNA, 1701 nt, Artificial Sequence
  derived and/or modified sequence opt2 from hemagglutinin__InfluenzaA__AFJ77781
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacuccgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100360 - RNA, 1701 nt, Artificial Sequence; identical to SEQ ID NO: 93307
  derived and/or modified sequence opt2 from hemagglutinin__InfluenzaA__AFJ77792

SEQ ID NO: 100361 - RNA, 1701 nt, Artificial Sequence; identical to SEQ ID NO: 93307
  derived and/or modified sequence opt2 from hemagglutinin__InfluenzaA__AFJ77803

SEQ ID NO: 100362 - RNA, 1701 nt, Artificial Sequence; identical to SEQ ID NO: 93307
  derived and/or modified sequence opt2 from hemagglutinin__InfluenzaA__AFJ77814

SEQ ID NO: 100363 - RNA, 1701 nt, Artificial Sequence; identical to SEQ ID NO: 93307
  derived and/or modified sequence opt2 from hemagglutinin__InfluenzaA__AFJ77825

SEQ ID NO: 100364 - RNA, 1701 nt, Artificial Sequence; identical to SEQ ID NO: 93307
  derived and/or modified sequence opt2 from hemagglutinin__InfluenzaA__AFJ77836

SEQ ID NO: 100365 - RNA, 1701 nt, Artificial Sequence; identical to SEQ ID NO: 93307
  derived and/or modified sequence opt2 from hemagglutinin__InfluenzaA__AFJ77847

SEQ ID NO: 100366 - RNA, 1701 nt, Artificial Sequence
  derived and/or modified sequence opt2 from hemagglutinin__InfluenzaA__AFJ77858
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccacccagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaacaagcucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccucuucugcgucgcccuccucggcuucaucaugugggccugccagaagggcaacauccgcugcaacaucugcaucuga

SEQ ID NO: 100367 - RNA, 1701 nt, Artificial Sequence
  derived and/or modified sequence opt2 from hemagglutinin__InfluenzaA__AFJ77869
augaagaccaucaucgccuucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100368 - RNA, 1701 nt, Artificial Sequence
  derived and/or modified sequence opt2 from hemagglutinin__InfluenzaA__AFJ77880
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100369 - RNA, 1701 nt, Artificial Sequence
  derived and/or modified sequence opt2 from hemagglutinin__InfluenzaA__AFJ77902
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucggccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100370 - RNA, 1701 nt, Artificial Sequence
  derived and/or modified sequence opt2 from hemagglutinin__InfluenzaA__AFJ77913
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccaggacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100371 - RNA, 1701 nt, Artificial Sequence; identical to SEQ ID NO: 92625
  derived and/or modified sequence opt2 from hemagglutinin__InfluenzaA__AFJ77924

SEQ ID NO: 100372 - RNA, 1701 nt, Artificial Sequence
  derived and/or modified sequence opt2 from hemagglutinin__InfluenzaA__AFJ77935
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcggcaucugcgacuccccccaccagauccucgacggcgagaacugcacccucauggacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaccuucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100373 - RNA, 1701 nt, Artificial Sequence
  derived and/or modified sequence opt2 from hemagglutinin__InfluenzaA__AFJ77946
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggaucaucuggaucuccuucgccaucuccugcuuccuccucugcgucgcccuccucggcuucaucaugugggccugccagaagggcaacauccgcugcaacaucugcaucuga

SEQ ID NO: 100374 - RNA, 1701 nt, Artificial Sequence; identical to SEQ ID NO: 93265
  derived and/or modified sequence opt2 from hemagglutinin__InfluenzaA__AFJ77957

SEQ ID NO: 100375 - RNA, 1701 nt, Artificial Sequence; identical to SEQ ID NO: 92142
  derived and/or modified sequence opt2 from hemagglutinin__InfluenzaA__AFJ77968

SEQ ID NO: 100376 - RNA, 1701 nt, Artificial Sequence
  derived and/or modified sequence opt2 from hemagglutinin__InfluenzaA__AFJ77979
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcuccgcuccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100377 - RNA, 1701 nt, Artificial Sequence
  derived and/or modified sequence opt2 from hemagglutinin__InfluenzaA__AFJ77990
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgaguaccgcgacgaggcccucaacaaccgcuuccagaucaagggcgucgagcucaaguccggcuacaaggacuggauccucuggaucuccuucgccaucuccugcuuccuccucugcgucacccuccucggcuucaucaugugggccugccagaagggcaacauccgcugcaacaucugcaucuga

SEQ ID NO: 100378 - RNA, 1701 nt, Artificial Sequence
  derived and/or modified sequence opt2 from hemagglutinin__InfluenzaA__AFJ78001
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcaagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucacccuccucggcuucaucaugugggccugccagaagggcaacauccgcugcaacaucugcaucuga

SEQ ID NO: 100379 - RNA, 1701 nt, Artificial Sequence
  derived and/or modified sequence opt2 from hemagglutinin__InfluenzaA__AFJ78012
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100380 - RNA, 1701 nt, Artificial Sequence
  derived and/or modified sequence opt2 from hemagglutinin__InfluenzaA__AFJ78023
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100381 - RNA, 1701 nt, Artificial Sequence; identical to SEQ ID NO: 92142
  derived and/or modified sequence opt2 from hemagglutinin__InfluenzaA__AFJ78034

SEQ ID NO: 100382 - RNA, 1701 nt, Artificial Sequence
  derived and/or modified sequence opt2 from hemagglutinin__InfluenzaA__AFJ78045
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaugggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 100383 - RNA, 1701 nt, Artificial Sequence; identical to SEQ ID NO: 92142
  derived and/or modified sequence opt2 from hemagglutinin__InfluenzaA__AFJ78056

SEQ ID NO: 100384 - RNA, 1701 nt, Artificial Sequence
  derived and/or modified sequence opt2 from hemagglutinin__InfluenzaA__AFJ78067
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100385 - RNA, 1701 nt, Artificial Sequence
  derived and/or modified sequence opt2 from hemagglutinin__InfluenzaA__AFJ78078
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100386 - RNA, 1701 nt, Artificial Sequence; identical to SEQ ID NO: 100309
  derived and/or modified sequence opt2 from hemagglutinin__InfluenzaA__AFJ78089

SEQ ID NO: 100387 - RNA, 1701 nt, Artificial Sequence; identical to SEQ ID NO: 93340
  derived and/or modified sequence opt2 from hemagglutinin__InfluenzaA__AFJ78100

SEQ ID NO: 100388 - RNA, 1701 nt, Artificial Sequence
  derived and/or modified sequence opt2 from hemagglutinin__InfluenzaA__AFJ78111
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100389 - RNA, 1701 nt, Artificial Sequence
  derived and/or modified sequence opt2 from hemagglutinin__InfluenzaA__AFJ78122
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucauccgcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100390 - RNA, 1701 nt, Artificial Sequence
  derived and/or modified sequence opt2 from hemagglutinin__InfluenzaA__AFJ78144
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100391 - RNA, 1701 nt, Artificial Sequence; identical to SEQ ID NO: 100390
  derived and/or modified sequence opt2 from hemagglutinin__InfluenzaA__AFJ78155

SEQ ID NO: 100392 - RNA, 1701 nt, Artificial Sequence
  derived and/or modified sequence opt2 from hemagglutinin__InfluenzaA__AFJ78166
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagcgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100393 - RNA, 1701 nt, Artificial Sequence; identical to SEQ ID NO: 93241
  derived and/or modified sequence opt2 from hemagglutinin__InfluenzaA__AFJ78177

SEQ ID NO: 100394 - RNA, 1701 nt, Artificial Sequence
  derived and/or modified sequence opt2 from hemagglutinin__InfluenzaA__AFJ78188
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100395 - RNA, 1701 nt, Artificial Sequence
  derived and/or modified sequence opt2 from hemagglutinin__InfluenzaA__AFJ78210
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100396 - RNA, 1701 nt, Artificial Sequence; identical to SEQ ID NO: 100320
  derived and/or modified sequence opt2 from hemagglutinin__InfluenzaA__AFJ78221

SEQ ID NO: 100397 - RNA, 1701 nt, Artificial Sequence
  derived and/or modified sequence opt2 from hemagglutinin__InfluenzaA__AFJ78232
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcaagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaacgaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100398 - RNA, 1701 nt, Artificial Sequence
  derived and/or modified sequence opt2 from hemagglutinin__InfluenzaA__AFJ78243
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgccaaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccgucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccacaagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100399 - RNA, 1701 nt, Artificial Sequence
  derived and/or modified sequence opt2 from hemagglutinin__InfluenzaA__AFJ78254
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100400 - RNA, 1701 nt, Artificial Sequence; identical to SEQ ID NO: 100399
  derived and/or modified sequence opt2 from hemagglutinin__InfluenzaA__AFJ78265

SEQ ID NO: 100401 - RNA, 1701 nt, Artificial Sequence
  derived and/or modified sequence opt2 from hemagglutinin__InfluenzaA__AFJ78276
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100402 - RNA, 1701 nt, Artificial Sequence
  derived and/or modified sequence opt2 from hemagglutinin__InfluenzaA__AFJ78287
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucauggacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100403 - RNA, 1698 nt, Artificial Sequence
  derived and/or modified sequence opt2 from hemagglutinin__InfluenzaA__AFJ78309
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccaucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100404 - RNA, 1701 nt, Artificial Sequence
  derived and/or modified sequence opt2 from hemagglutinin__InfluenzaA__AFJ78320
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100405 - RNA, 1698 nt, Artificial Sequence
  derived and/or modified sequence opt2 from hemagglutinin__InfluenzaA__AFJ78331
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100406 - RNA, 1698 nt, Artificial Sequence; identical to SEQ ID NO: 100405
  derived and/or modified sequence opt2 from hemagglutinin__InfluenzaA__AFJ78342

SEQ ID NO: 100407 - RNA, 1698 nt, Artificial Sequence; identical to SEQ ID NO: 100405
  derived and/or modified sequence opt2 from hemagglutinin__InfluenzaA__AFJ78353

SEQ ID NO: 100408 - RNA, 1698 nt, Artificial Sequence
  derived and/or modified sequence opt2 from hemagglutinin__InfluenzaA__AFJ78364
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccaucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100409 - RNA, 1698 nt, Artificial Sequence
  derived and/or modified sequence opt2 from hemagglutinin__InfluenzaA__AFJ78375
augaaggccaagcuccucguccuccucugcaccuucaccgccaccuacgccgacaccaucugcaucggcuaccacgccaacaacuccaccgacaccgucgacaccguccucgagaagaacgucaccgucacccacuccaucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgucaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100410 - RNA, 1698 nt, Artificial Sequence; identical to SEQ ID NO: 92897
  derived and/or modified sequence opt2 from hemagglutinin__InfluenzaA__AFJ78386

SEQ ID NO: 100411 - RNA, 1698 nt, Artificial Sequence; identical to SEQ ID NO: 92897
  derived and/or modified sequence opt2 from hemagglutinin__InfluenzaA__AFJ78397

SEQ ID NO: 100412 - RNA, 1698 nt, Artificial Sequence; identical to SEQ ID NO: 99589
  derived and/or modified sequence opt2 from hemagglutinin__InfluenzaA__AFJ78408

SEQ ID NO: 100413 - RNA, 1698 nt, Artificial Sequence
  derived and/or modified sequence opt2 from hemagglutinin__InfluenzaA__AFJ78419
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccgucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100414 - RNA, 1698 nt, Artificial Sequence
  derived and/or modified sequence opt2 from hemagglutinin__InfluenzaA__AFJ78430
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaaccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucggccccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100415 - RNA, 1698 nt, Artificial Sequence
  derived and/or modified sequence opt2 from hemagglutinin__InfluenzaA__AFJ78441
augaaggucaagcucaugguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucgacaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100416 - RNA, 1698 nt, Artificial Sequence
  derived and/or modified sequence opt2 from hemagglutinin__InfluenzaA__AFJ78452
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucauccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100417 - RNA, 1698 nt, Artificial Sequence
  derived and/or modified sequence opt2 from hemagglutinin__InfluenzaA__AFJ78463
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucggcaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucauccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100418 - RNA, 1698 nt, Artificial Sequence
  derived and/or modified sequence opt2 from hemagglutinin__InfluenzaA__AFJ78474
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcuccuacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100419 - RNA, 1698 nt, Artificial Sequence
  derived and/or modified sequence opt2 from hemagglutinin__InfluenzaA__AFJ78485
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgaggacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100420 - RNA, 1698 nt, Artificial Sequence
  derived and/or modified sequence opt2 from hemagglutinin__InfluenzaA__AFJ78496
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcggccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100421 - RNA, 1698 nt, Artificial Sequence
  derived and/or modified sequence opt2 from hemagglutinin__InfluenzaA__AFJ78518
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100422 - RNA, 1698 nt, Artificial Sequence
  derived and/or modified sequence opt2 from hemagglutinin__InfluenzaA__AFJ78529
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100423 - RNA, 1698 nt, Artificial Sequence; identical to SEQ ID NO: 100422
  derived and/or modified sequence opt2 from hemagglutinin__InfluenzaA__AFJ78540

SEQ ID NO: 100424 - RNA, 1698 nt, Artificial Sequence; identical to SEQ ID NO: 100422
  derived and/or modified sequence opt2 from hemagglutinin__InfluenzaA__AFJ78551

SEQ ID NO: 100425 - RNA, 1698 nt, Artificial Sequence
  derived and/or modified sequence opt2 from hemagglutinin__InfluenzaA__AFJ78562
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccacccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccucaagguccgcgaccaggagggccgcaucaacuacuacuggacccuccucgagcccggcgacaccaucaucuucgaggccaacggcaaccucaucgccccccgcuacgccuucgcccucucccgcggccucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100426 - RNA, 1698 nt, Artificial Sequence
  derived and/or modified sequence opt2 from hemagglutinin__InfluenzaA__AFJ78573
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgccuccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaggccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100427 - RNA, 1698 nt, Artificial Sequence
  derived and/or modified sequence opt2 from hemagglutinin__InfluenzaA__AFJ78584
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucacccgcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucgccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100428 - RNA, 1698 nt, Artificial Sequence
  derived and/or modified sequence opt2 from hemagglutinin__InfluenzaA__AFJ78595
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaaccgcgagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100429 - RNA, 1698 nt, Artificial Sequence
  derived and/or modified sequence opt2 from hemagglutinin__InfluenzaA__AFJ78617
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacgacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgcccacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucuccaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100430 - RNA, 1698 nt, Artificial Sequence
  derived and/or modified sequence opt2 from hemagglutinin__InfluenzaA__AFJ78628
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100431 - RNA, 1698 nt, Artificial Sequence
  derived and/or modified sequence opt2 from hemagglutinin__InfluenzaA__AFJ78639
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100432 - RNA, 1698 nt, Artificial Sequence; identical to SEQ ID NO: 100431
  derived and/or modified sequence opt2 from hemagglutinin__InfluenzaA__AFJ78650

SEQ ID NO: 100433 - RNA, 1701 nt, Artificial Sequence; identical to SEQ ID NO: 94181
  derived and/or modified sequence opt2 from hemagglutinin__InfluenzaA__AFJ78661

SEQ ID NO: 100434 - RNA, 1701 nt, Artificial Sequence
  derived and/or modified sequence opt2 from hemagglutinin__InfluenzaA__AFJ78681
augaaggccauccucgucguccuccucuacaccuucgccaccgucaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100435 - RNA, 1701 nt, Artificial Sequence; identical to SEQ ID NO: 94181
  derived and/or modified sequence opt2 from hemagglutinin__InfluenzaA__AFJ78691

SEQ ID NO: 100436 - RNA, 1701 nt, Artificial Sequence; identical to SEQ ID NO: 94181
  derived and/or modified sequence opt2 from hemagglutinin__InfluenzaA__AFJ78701

SEQ ID NO: 100437 - RNA, 1701 nt, Artificial Sequence; identical to SEQ ID NO: 98709
  derived and/or modified sequence opt2 from hemagglutinin__InfluenzaA__AFJ78711

SEQ ID NO: 100438 - RNA, 1701 nt, Artificial Sequence; identical to SEQ ID NO: 94181
  derived and/or modified sequence opt2 from hemagglutinin__InfluenzaA__AFJ78721

SEQ ID NO: 100439 - RNA, 1701 nt, Artificial Sequence
  derived and/or modified sequence opt2 from hemagglutinin__InfluenzaA__AFJ78731
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcuccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100440 - RNA, 1701 nt, Artificial Sequence; identical to SEQ ID NO: 95345
  derived and/or modified sequence opt2 from hemagglutinin__InfluenzaA__AFJ78741

SEQ ID NO: 100441 - RNA, 1701 nt, Artificial Sequence; identical to SEQ ID NO: 94181
  derived and/or modified sequence opt2 from hemagglutinin__InfluenzaA__AFJ78751

SEQ ID NO: 100442 - RNA, 1701 nt, Artificial Sequence; identical to SEQ ID NO: 94181
  derived and/or modified sequence opt2 from hemagglutinin__InfluenzaA__AFJ78761

SEQ ID NO: 100443 - RNA, 1701 nt, Artificial Sequence; identical to SEQ ID NO: 94181
  derived and/or modified sequence opt2 from hemagglutinin__InfluenzaA__AFJ78771

SEQ ID NO: 100444 - RNA, 1701 nt, Artificial Sequence; identical to SEQ ID NO: 94181
  derived and/or modified sequence opt2 from hemagglutinin__InfluenzaA__AFJ78781

SEQ ID NO: 100445 - RNA, 1701 nt, Artificial Sequence; identical to SEQ ID NO: 94181
  derived and/or modified sequence opt2 from hemagglutinin__InfluenzaA__AFJ78791

SEQ ID NO: 100446 - RNA, 1701 nt, Artificial Sequence; identical to SEQ ID NO: 94181
  derived and/or modified sequence opt2 from hemagglutinin__InfluenzaA__AFJ78801

SEQ ID NO: 100447 - RNA, 1701 nt, Artificial Sequence; identical to SEQ ID NO: 95042
  derived and/or modified sequence opt2 from hemagglutinin__InfluenzaA__AFJ78811

SEQ ID NO: 100448 - RNA, 1701 nt, Artificial Sequence; identical to SEQ ID NO: 94181
  derived and/or modified sequence opt2 from hemagglutinin__InfluenzaA__AFJ78821

SEQ ID NO: 100449 - RNA, 1701 nt, Artificial Sequence; identical to SEQ ID NO: 94181
  derived and/or modified sequence opt2 from hemagglutinin__InfluenzaA__AFJ78831

SEQ ID NO: 100450 - RNA, 1701 nt, Artificial Sequence; identical to SEQ ID NO: 95379
  derived and/or modified sequence opt2 from hemagglutinin__InfluenzaA__AFJ78841

SEQ ID NO: 100451 - RNA, 1701 nt, Artificial Sequence; identical to SEQ ID NO: 94181
  derived and/or modified sequence opt2 from hemagglutinin__InfluenzaA__AFJ78851

SEQ ID NO: 100452 - RNA, 1701 nt, Artificial Sequence
  derived and/or modified sequence opt2 from hemagglutinin__InfluenzaA__AFJ78861
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccgccuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100453 - RNA, 1701 nt, Artificial Sequence
  derived and/or modified sequence opt2 from hemagglutinin__InfluenzaA__AFJ78881
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 100454 - RNA, 1701 nt, Artificial Sequence; identical to SEQ ID NO: 94181
  derived and/or modified sequence opt2 from hemagglutinin__InfluenzaA__AFJ78891

SEQ ID NO: 100455 - RNA, 1701 nt, Artificial Sequence; identical to SEQ ID NO: 94181
  derived and/or modified sequence opt2 from hemagglutinin__InfluenzaA__AFJ78901

SEQ ID NO: 100456 - RNA, 1701 nt, Artificial Sequence; identical to SEQ ID NO: 94181
  derived and/or modified sequence opt2 from hemagglutinin__InfluenzaA__AFJ78911

SEQ ID NO: 100457 - RNA, 1701 nt, Artificial Sequence; identical to SEQ ID NO: 94181
  derived and/or modified sequence opt2 from hemagglutinin__InfluenzaA__AFJ78921

SEQ ID NO: 100458 - RNA, 1701 nt, Artificial Sequence
  derived and/or modified sequence opt2 from hemagglutinin__InfluenzaA__AFJ97567
augaaggccauccucgucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccuccuuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100459 - RNA, 1701 nt, Artificial Sequence; identical to SEQ ID NO: 94181
  derived and/or modified sequence opt2 from hemagglutinin__InfluenzaA__AFK14115

SEQ ID NO: 100460 - RNA, 1701 nt, Artificial Sequence; identical to SEQ ID NO: 94181
  derived and/or modified sequence opt2 from hemagglutinin__InfluenzaA__AFK14131

SEQ ID NO: 100461 - RNA, 1701 nt, Artificial Sequence; identical to SEQ ID NO: 95863
  derived and/or modified sequence opt2 from hemagglutinin__InfluenzaA__AFK14139

SEQ ID NO: 100462 - RNA, 1701 nt, Artificial Sequence
  derived and/or modified sequence opt2 from hemagglutinin__InfluenzaA__AFK14148
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100463 - RNA, 1701 nt, Artificial Sequence; identical to SEQ ID NO: 95808
  derived and/or modified sequence opt2 from hemagglutinin__InfluenzaA__AFK14157

SEQ ID NO: 100464 - RNA, 1701 nt, Artificial Sequence; identical to SEQ ID NO: 94181
  derived and/or modified sequence opt2 from hemagglutinin__InfluenzaA__AFK14166

SEQ ID NO: 100465 - RNA, 1701 nt, Artificial Sequence; identical to SEQ ID NO: 95509
  derived and/or modified sequence opt2 from hemagglutinin__InfluenzaA__AFK14175

SEQ ID NO: 100466 - RNA, 1701 nt, Artificial Sequence; identical to SEQ ID NO: 97086
  derived and/or modified sequence opt2 from hemagglutinin__InfluenzaA__AFK14184

SEQ ID NO: 100467 - RNA, 1701 nt, Artificial Sequence; identical to SEQ ID NO: 94534
  derived and/or modified sequence opt2 from hemagglutinin__InfluenzaA__AFK14193

SEQ ID NO: 100468 - RNA, 1701 nt, Artificial Sequence; identical to SEQ ID NO: 95778
  derived and/or modified sequence opt2 from hemagglutinin__InfluenzaA__AFK14202

SEQ ID NO: 100469 - RNA, 1701 nt, Artificial Sequence; identical to SEQ ID NO: 94534
  derived and/or modified sequence opt2 from hemagglutinin__InfluenzaA__AFK14211

SEQ ID NO: 100470 - RNA, 1701 nt, Artificial Sequence
  derived and/or modified sequence opt2 from hemagglutinin__InfluenzaA__AFK14220
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgccuccuccuucgagcgcuacgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100471 - RNA, 1701 nt, Artificial Sequence; identical to SEQ ID NO: 95808
  derived and/or modified sequence opt2 from hemagglutinin__InfluenzaA__AFK14229

SEQ ID NO: 100472 - RNA, 1701 nt, Artificial Sequence; identical to SEQ ID NO: 98946
  derived and/or modified sequence opt2 from hemagglutinin__InfluenzaA__AFK14238

SEQ ID NO: 100473 - RNA, 1701 nt, Artificial Sequence
  derived and/or modified sequence opt2 from hemagglutinin__InfluenzaA__AFK14247
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaugaacaccucccuccccuuccagaacauccaccccaucaccaucggcaagugccccaaguacgucaaguccaccaagcuccgcauggccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100474 - RNA, 1701 nt, Artificial Sequence
  derived and/or modified sequence opt2 from hemagglutinin__InfluenzaA__AFK14272
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaccggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100475 - RNA, 1701 nt, Artificial Sequence; identical to SEQ ID NO: 94534
  derived and/or modified sequence opt2 from hemagglutinin__InfluenzaA__AFK14314

SEQ ID NO: 100476 - RNA, 1701 nt, Artificial Sequence
  derived and/or modified sequence opt2 from hemagglutinin__InfluenzaA__AFK14323
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100477 - RNA, 1701 nt, Artificial Sequence; identical to SEQ ID NO: 98946
  derived and/or modified sequence opt2 from hemagglutinin__InfluenzaA__AFK14332

SEQ ID NO: 100478 - RNA, 1701 nt, Artificial Sequence
  derived and/or modified sequence opt2 from hemagglutinin__InfluenzaA__AFK14341
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagaagacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100479 - RNA, 1701 nt, Artificial Sequence; identical to SEQ ID NO: 95601
  derived and/or modified sequence opt2 from hemagglutinin__InfluenzaA__AFK14350

SEQ ID NO: 100480 - RNA, 1701 nt, Artificial Sequence
  derived and/or modified sequence opt2 from hemagglutinin__InfluenzaA__AFK14358
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcgccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagaagacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100481 - RNA, 1701 nt, Artificial Sequence
  derived and/or modified sequence opt2 from hemagglutinin__InfluenzaA__AFK14395
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgagaacggcaugugcugcccccgcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 100482 - RNA, 1701 nt, Artificial Sequence
  derived and/or modified sequence opt2 from hemagglutinin__InfluenzaA__AFK14431
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuuccucgacuacgaggagcuccgcaagcagcucuccuccgucuccuccuucgagcgcgucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100483 - RNA, 1701 nt, Artificial Sequence; identical to SEQ ID NO: 94181
  derived and/or modified sequence opt2 from hemagglutinin__InfluenzaA__AFK14456

SEQ ID NO: 100484 - RNA, 1701 nt, Artificial Sequence; identical to SEQ ID NO: 94181
  derived and/or modified sequence opt2 from hemagglutinin__InfluenzaA__AFK14465

SEQ ID NO: 100485 - RNA, 1701 nt, Artificial Sequence
  derived and/or modified sequence opt2 from hemagglutinin__InfluenzaA__AFK14536
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuacuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100486 - RNA, 1701 nt, Artificial Sequence; identical to SEQ ID NO: 94181
  derived and/or modified sequence opt2 from hemagglutinin__InfluenzaA__AFK14571

SEQ ID NO: 100487 - RNA, 1701 nt, Artificial Sequence; identical to SEQ ID NO: 98690
  derived and/or modified sequence opt2 from hemagglutinin__InfluenzaA__AFK14586

SEQ ID NO: 100488 - RNA, 1701 nt, Artificial Sequence
  derived and/or modified sequence opt2 from hemagglutinin__InfluenzaA__AFK14595
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccaagugcgagucccucuccaccgccuccuccugguccuacaucggcgagaccuccuccuccaacaacggcaccugcuaccccggcaacuucaucgacuucgaggagcucaagaagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100489 - RNA, 1701 nt, Artificial Sequence; identical to SEQ ID NO: 98690
  derived and/or modified sequence opt2 from hemagglutinin__InfluenzaA__AFK14612

SEQ ID NO: 100490 - RNA, 1701 nt, Artificial Sequence; identical to SEQ ID NO: 94181
  derived and/or modified sequence opt2 from hemagglutinin__InfluenzaA__AFK14621

SEQ ID NO: 100491 - RNA, 1701 nt, Artificial Sequence
  derived and/or modified sequence opt2 from hemagglutinin__InfluenzaA__AFK14630
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccacccgcgccgaccuccaguccaucaaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100492 - RNA, 1701 nt, Artificial Sequence
  derived and/or modified sequence opt2 from hemagglutinin__InfluenzaA__AFK14639
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcggccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100493 - RNA, 1701 nt, Artificial Sequence; identical to SEQ ID NO: 94181
  derived and/or modified sequence opt2 from hemagglutinin__InfluenzaA__AFK14661

SEQ ID NO: 100494 - RNA, 1701 nt, Artificial Sequence; identical to SEQ ID NO: 98690
  derived and/or modified sequence opt2 from hemagglutinin__InfluenzaA__AFK14670

SEQ ID NO: 100495 - RNA, 1701 nt, Artificial Sequence; identical to SEQ ID NO: 98690
  derived and/or modified sequence opt2 from hemagglutinin__InfluenzaA__AFK14678

SEQ ID NO: 100496 - RNA, 1701 nt, Artificial Sequence
  derived and/or modified sequence opt2 from hemagglutinin__InfluenzaA__AFK14688
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucauccacgacgaggagcuccgcaagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaaggccggcuccggcaucaucauccucgacacccccguccacgacuggaacaccaccugcgagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100497 - RNA, 1701 nt, Artificial Sequence; identical to SEQ ID NO: 98690
  derived and/or modified sequence opt2 from hemagglutinin__InfluenzaA__AFK14697

SEQ ID NO: 100498 - RNA, 1701 nt, Artificial Sequence; identical to SEQ ID NO: 98690
  derived and/or modified sequence opt2 from hemagglutinin__InfluenzaA__AFK14713

SEQ ID NO: 100499 - RNA, 1701 nt, Artificial Sequence; identical to SEQ ID NO: 98690
  derived and/or modified sequence opt2 from hemagglutinin__InfluenzaA__AFK14722

SEQ ID NO: 100500 - RNA, 1701 nt, Artificial Sequence
  derived and/or modified sequence opt2 from hemagglutinin__InfluenzaA__AFK14731
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcaagcagcucuccuccgucuccuccuucgagcgcgucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100501 - RNA, 1701 nt, Artificial Sequence; identical to SEQ ID NO: 98690
  derived and/or modified sequence opt2 from hemagglutinin__InfluenzaA__AFK14740

SEQ ID NO: 100502 - RNA, 1701 nt, Artificial Sequence; identical to SEQ ID NO: 98690
  derived and/or modified sequence opt2 from hemagglutinin__InfluenzaA__AFK14749

SEQ ID NO: 100503 - RNA, 1701 nt, Artificial Sequence; identical to SEQ ID NO: 98690
  derived and/or modified sequence opt2 from hemagglutinin__InfluenzaA__AFK14756

SEQ ID NO: 100504 - RNA, 1701 nt, Artificial Sequence; identical to SEQ ID NO: 98690
  derived and/or modified sequence opt2 from hemagglutinin__InfluenzaA__AFK14764

SEQ ID NO: 100505 - RNA, 1701 nt, Artificial Sequence
  derived and/or modified sequence opt2 from hemagglutinin__InfluenzaA__AFK14779
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100506 - RNA, 1701 nt, Artificial Sequence
  derived and/or modified sequence opt2 from hemagglutinin__InfluenzaA__AFK14788
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgcaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 100507 - RNA, 1701 nt, Artificial Sequence
  derived and/or modified sequence opt2 from hemagglutinin__InfluenzaA__AFK14798
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcaagcagcucuccuccgucuccuccuucgagcgcgucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100508 - RNA, 1701 nt, Artificial Sequence
  derived and/or modified sequence opt2 from hemagglutinin__InfluenzaA__AFK14814
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuacgagcgcuacgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100509 - RNA, 1701 nt, Artificial Sequence
  derived and/or modified sequence opt2 from hemagglutinin__InfluenzaA__AFK14831
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucuccgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100510 - RNA, 1701 nt, Artificial Sequence; identical to SEQ ID NO: 94181
  derived and/or modified sequence opt2 from hemagglutinin__InfluenzaA__AFK14839

SEQ ID NO: 100511 - RNA, 1701 nt, Artificial Sequence
  derived and/or modified sequence opt2 from hemagglutinin__InfluenzaA__AFK14847
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgccuccuccuucgagcgcuacgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100512 - RNA, 1701 nt, Artificial Sequence; identical to SEQ ID NO: 98690
  derived and/or modified sequence opt2 from hemagglutinin__InfluenzaA__AFK14868

SEQ ID NO: 100513 - RNA, 1701 nt, Artificial Sequence; identical to SEQ ID NO: 95345
  derived and/or modified sequence opt2 from hemagglutinin__InfluenzaA__AFK14884

SEQ ID NO: 100514 - RNA, 1701 nt, Artificial Sequence; identical to SEQ ID NO: 95345
  derived and/or modified sequence opt2 from hemagglutinin__InfluenzaA__AFK14892

SEQ ID NO: 100515 - RNA, 1701 nt, Artificial Sequence; identical to SEQ ID NO: 95345
  derived and/or modified sequence opt2 from hemagglutinin__InfluenzaA__AFK14901

SEQ ID NO: 100516 - RNA, 1701 nt, Artificial Sequence; identical to SEQ ID NO: 95345
  derived and/or modified sequence opt2 from hemagglutinin__InfluenzaA__AFK14910

SEQ ID NO: 100517 - RNA, 1701 nt, Artificial Sequence; identical to SEQ ID NO: 94181
  derived and/or modified sequence opt2 from hemagglutinin__InfluenzaA__AFK14919

SEQ ID NO: 100518 - RNA, 1701 nt, Artificial Sequence; identical to SEQ ID NO: 94181
  derived and/or modified sequence opt2 from hemagglutinin__InfluenzaA__AFK14929

SEQ ID NO: 100519 - RNA, 1701 nt, Artificial Sequence; identical to SEQ ID NO: 99698
  derived and/or modified sequence opt2 from hemagglutinin__InfluenzaA__AFK25599

SEQ ID NO: 100520 - RNA, 1701 nt, Artificial Sequence
  derived and/or modified sequence opt2 from hemagglutinin__InfluenzaA__AFK25601
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgucacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 100521 - RNA, 1701 nt, Artificial Sequence; identical to SEQ ID NO: 99698
  derived and/or modified sequence opt2 from hemagglutinin__InfluenzaA__AFK25603

SEQ ID NO: 100522 - RNA, 1701 nt, Artificial Sequence
  derived and/or modified sequence opt2 from hemagglutinin__InfluenzaA__AFK25605
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacguccgcuccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 100523 - RNA, 1701 nt, Artificial Sequence; identical to SEQ ID NO: 99926
  derived and/or modified sequence opt2 from hemagglutinin__InfluenzaA__AFK74526

SEQ ID NO: 100524 - RNA, 1701 nt, Artificial Sequence; identical to SEQ ID NO: 94181
  derived and/or modified sequence opt2 from hemagglutinin__InfluenzaA__AFK74534

SEQ ID NO: 100525 - RNA, 1701 nt, Artificial Sequence; identical to SEQ ID NO: 94181
  derived and/or modified sequence opt2 from hemagglutinin__InfluenzaA__AFK74544

SEQ ID NO: 100526 - RNA, 1701 nt, Artificial Sequence; identical to SEQ ID NO: 94181
  derived and/or modified sequence opt2 from hemagglutinin__InfluenzaA__AFK74554

SEQ ID NO: 100527 - RNA, 1701 nt, Artificial Sequence; identical to SEQ ID NO: 94423
  derived and/or modified sequence opt2 from hemagglutinin__InfluenzaA__AFK74564

SEQ ID NO: 100528 - RNA, 1701 nt, Artificial Sequence; identical to SEQ ID NO: 96736
  derived and/or modified sequence opt2 from hemagglutinin__InfluenzaA__AFK74575

SEQ ID NO: 100529 - RNA, 1701 nt, Artificial Sequence; identical to SEQ ID NO: 94168
  derived and/or modified sequence opt2 from hemagglutinin__InfluenzaA__AFK74585

SEQ ID NO: 100530 - RNA, 1701 nt, Artificial Sequence
  derived and/or modified sequence opt2 from hemagglutinin__InfluenzaA__AFK74595
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100531 - RNA, 1701 nt, Artificial Sequence; identical to SEQ ID NO: 94181
  derived and/or modified sequence opt2 from hemagglutinin__InfluenzaA__AFK74605

SEQ ID NO: 100532 - RNA, 1701 nt, Artificial Sequence; identical to SEQ ID NO: 94423
  derived and/or modified sequence opt2 from hemagglutinin__InfluenzaA__AFK74615

SEQ ID NO: 100533 - RNA, 1701 nt, Artificial Sequence; identical to SEQ ID NO: 94423
  derived and/or modified sequence opt2 from hemagglutinin__InfluenzaA__AFK74625

SEQ ID NO: 100534 - RNA, 1701 nt, Artificial Sequence; identical to SEQ ID NO: 95283
  derived and/or modified sequence opt2 from hemagglutinin__InfluenzaA__AFK74635

SEQ ID NO: 100535 - RNA, 1701 nt, Artificial Sequence; identical to SEQ ID NO: 95283
  derived and/or modified sequence opt2 from hemagglutinin__InfluenzaA__AFK74645

SEQ ID NO: 100536 - RNA, 1701 nt, Artificial Sequence; identical to SEQ ID NO: 94181
  derived and/or modified sequence opt2 from hemagglutinin__InfluenzaA__AFK74655

SEQ ID NO: 100537 - RNA, 1701 nt, Artificial Sequence; identical to SEQ ID NO: 94181
  derived and/or modified sequence opt2 from hemagglutinin__InfluenzaA__AFK74665

SEQ ID NO: 100538 - RNA, 1701 nt, Artificial Sequence; identical to SEQ ID NO: 94181
  derived and/or modified sequence opt2 from hemagglutinin__InfluenzaA__AFK74675

SEQ ID NO: 100539 - RNA, 1701 nt, Artificial Sequence; identical to SEQ ID NO: 94181
  derived and/or modified sequence opt2 from hemagglutinin__InfluenzaA__AFK74685

SEQ ID NO: 100540 - RNA, 1701 nt, Artificial Sequence; identical to SEQ ID NO: 96736
  derived and/or modified sequence opt2 from hemagglutinin__InfluenzaA__AFK74695

SEQ ID NO: 100541 - RNA, 1701 nt, Artificial Sequence; identical to SEQ ID NO: 94181
  derived and/or modified sequence opt2 from hemagglutinin__InfluenzaA__AFK74705

SEQ ID NO: 100542 - RNA, 1701 nt, Artificial Sequence; identical to SEQ ID NO: 94181
  derived and/or modified sequence opt2 from hemagglutinin__InfluenzaA__AFK74715

SEQ ID NO: 100543 - RNA, 1701 nt, Artificial Sequence; identical to SEQ ID NO: 94181
  derived and/or modified sequence opt2 from hemagglutinin__InfluenzaA__AFK74725

SEQ ID NO: 100544 - RNA, 1701 nt, Artificial Sequence; identical to SEQ ID NO: 94181
  derived and/or modified sequence opt2 from hemagglutinin__InfluenzaA__AFK74735

SEQ ID NO: 100545 - RNA, 1701 nt, Artificial Sequence; identical to SEQ ID NO: 94181
  derived and/or modified sequence opt2 from hemagglutinin__InfluenzaA__AFK74745

SEQ ID NO: 100546 - RNA, 1701 nt, Artificial Sequence; identical to SEQ ID NO: 94181
  derived and/or modified sequence opt2 from hemagglutinin__InfluenzaA__AFK74755

SEQ ID NO: 100547 - RNA, 1701 nt, Artificial Sequence; identical to SEQ ID NO: 96736
  derived and/or modified sequence opt2 from hemagglutinin__InfluenzaA__AFK74765

SEQ ID NO: 100548 - RNA, 1701 nt, Artificial Sequence; identical to SEQ ID NO: 94181
  derived and/or modified sequence opt2 from hemagglutinin__InfluenzaA__AFK74775

SEQ ID NO: 100549 - RNA, 1701 nt, Artificial Sequence; identical to SEQ ID NO: 94181
  derived and/or modified sequence opt2 from hemagglutinin__InfluenzaA__AFK74785

SEQ ID NO: 100550 - RNA, 1701 nt, Artificial Sequence; identical to SEQ ID NO: 94181
  derived and/or modified sequence opt2 from hemagglutinin__InfluenzaA__AFK74795

SEQ ID NO: 100551 - RNA, 1701 nt, Artificial Sequence; identical to SEQ ID NO: 94181
  derived and/or modified sequence opt2 from hemagglutinin__InfluenzaA__AFK74805

SEQ ID NO: 100552 - RNA, 1701 nt, Artificial Sequence; identical to SEQ ID NO: 94181
  derived and/or modified sequence opt2 from hemagglutinin__InfluenzaA__AFK74815

SEQ ID NO: 100553 - RNA, 1701 nt, Artificial Sequence; identical to SEQ ID NO: 94181
  derived and/or modified sequence opt2 from hemagglutinin__InfluenzaA__AFK74825

SEQ ID NO: 100554 - RNA, 1701 nt, Artificial Sequence; identical to SEQ ID NO: 94181
  derived and/or modified sequence opt2 from hemagglutinin__InfluenzaA__AFK74835

SEQ ID NO: 100555 - RNA, 1701 nt, Artificial Sequence; identical to SEQ ID NO: 94181
  derived and/or modified sequence opt2 from hemagglutinin__InfluenzaA__AFK74845

SEQ ID NO: 100556 - RNA, 1701 nt, Artificial Sequence; identical to SEQ ID NO: 94181
  derived and/or modified sequence opt2 from hemagglutinin__InfluenzaA__AFK74895

SEQ ID NO: 100557 - RNA, 1701 nt, Artificial Sequence; identical to SEQ ID NO: 94181
  derived and/or modified sequence opt2 from hemagglutinin__InfluenzaA__AFK74905

SEQ ID NO: 100558 - RNA, 1701 nt, Artificial Sequence; identical to SEQ ID NO: 94181
  derived and/or modified sequence opt2 from hemagglutinin__InfluenzaA__AFK74915

SEQ ID NO: 100559 - RNA, 1701 nt, Artificial Sequence
  derived and/or modified sequence opt2 from hemagglutinin__InfluenzaA__AFK74925
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgucccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100560 - RNA, 1701 nt, Artificial Sequence; identical to SEQ ID NO: 95283
  derived and/or modified sequence opt2 from hemagglutinin__InfluenzaA__AFK74935

SEQ ID NO: 100561 - RNA, 1701 nt, Artificial Sequence; identical to SEQ ID NO: 94181
  derived and/or modified sequence opt2 from hemagglutinin__InfluenzaA__AFK74945

SEQ ID NO: 100562 - RNA, 1701 nt, Artificial Sequence; identical to SEQ ID NO: 94181
  derived and/or modified sequence opt2 from hemagglutinin__InfluenzaA__AFK74955

SEQ ID NO: 100563 - RNA, 1701 nt, Artificial Sequence; identical to SEQ ID NO: 94181
  derived and/or modified sequence opt2 from hemagglutinin__InfluenzaA__AFK74965

SEQ ID NO: 100564 - RNA, 1701 nt, Artificial Sequence; identical to SEQ ID NO: 94272
  derived and/or modified sequence opt2 from hemagglutinin__InfluenzaA__AFK74975

SEQ ID NO: 100565 - RNA, 1701 nt, Artificial Sequence; identical to SEQ ID NO: 94181
  derived and/or modified sequence opt2 from hemagglutinin__InfluenzaA__AFK74985

SEQ ID NO: 100566 - RNA, 1701 nt, Artificial Sequence; identical to SEQ ID NO: 96736
  derived and/or modified sequence opt2 from hemagglutinin__InfluenzaA__AFK74995

SEQ ID NO: 100567 - RNA, 1701 nt, Artificial Sequence; identical to SEQ ID NO: 94181
  derived and/or modified sequence opt2 from hemagglutinin__InfluenzaA__AFK75005

SEQ ID NO: 100568 - RNA, 1701 nt, Artificial Sequence
  derived and/or modified sequence opt2 from hemagglutinin__InfluenzaA__AFK75015
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcgucuga

SEQ ID NO: 100569 - RNA, 1701 nt, Artificial Sequence; identical to SEQ ID NO: 94423
  derived and/or modified sequence opt2 from hemagglutinin__InfluenzaA__AFK75025

SEQ ID NO: 100570 - RNA, 1701 nt, Artificial Sequence; identical to SEQ ID NO: 94423
  derived and/or modified sequence opt2 from hemagglutinin__InfluenzaA__AFK75035

SEQ ID NO: 100571 - RNA, 1701 nt, Artificial Sequence; identical to SEQ ID NO: 94423
  derived and/or modified sequence opt2 from hemagglutinin__InfluenzaA__AFK75045

SEQ ID NO: 100572 - RNA, 1701 nt, Artificial Sequence; identical to SEQ ID NO: 94423
  derived and/or modified sequence opt2 from hemagglutinin__InfluenzaA__AFK75055

SEQ ID NO: 100573 - RNA, 1701 nt, Artificial Sequence; identical to SEQ ID NO: 94181
  derived and/or modified sequence opt2 from hemagglutinin__InfluenzaA__AFK75065

SEQ ID NO: 100574 - RNA, 1701 nt, Artificial Sequence; identical to SEQ ID NO: 94181
  derived and/or modified sequence opt2 from hemagglutinin__InfluenzaA__AFK75075

SEQ ID NO: 100575 - RNA, 1701 nt, Artificial Sequence; identical to SEQ ID NO: 95345
  derived and/or modified sequence opt2 from hemagglutinin__InfluenzaA__AFK75085

SEQ ID NO: 100576 - RNA, 1701 nt, Artificial Sequence; identical to SEQ ID NO: 95345
  derived and/or modified sequence opt2 from hemagglutinin__InfluenzaA__AFK75095

SEQ ID NO: 100577 - RNA, 1701 nt, Artificial Sequence; identical to SEQ ID NO: 94181
  derived and/or modified sequence opt2 from hemagglutinin__InfluenzaA__AFK75105

SEQ ID NO: 100578 - RNA, 1701 nt, Artificial Sequence; identical to SEQ ID NO: 94423
  derived and/or modified sequence opt2 from hemagglutinin__InfluenzaA__AFK77857

SEQ ID NO: 100579 - RNA, 1701 nt, Artificial Sequence; identical to SEQ ID NO: 94423
  derived and/or modified sequence opt2 from hemagglutinin__InfluenzaA__AFK77867

SEQ ID NO: 100580 - RNA, 1701 nt, Artificial Sequence; identical to SEQ ID NO: 99709
  derived and/or modified sequence opt2 from hemagglutinin__InfluenzaA__AFK77877

SEQ ID NO: 100581 - RNA, 1701 nt, Artificial Sequence; identical to SEQ ID NO: 94181
  derived and/or modified sequence opt2 from hemagglutinin__InfluenzaA__AFK77887

SEQ ID NO: 100582 - RNA, 1701 nt, Artificial Sequence
  derived and/or modified sequence opt2 from hemagglutinin__InfluenzaA__AFK77897
augaaggccauccucgucguccuccucuacaccuucgccaccgccaacgccgacacccucugcaucggcuaccacgccaacaacuccaccgacaccgucgacaccguccucgagaagaacgucaccgucacccacuccaucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100583 - RNA, 1701 nt, Artificial Sequence; identical to SEQ ID NO: 98562
  derived and/or modified sequence opt2 from hemagglutinin__InfluenzaA__AFK78028

SEQ ID NO: 100584 - RNA, 1701 nt, Artificial Sequence; identical to SEQ ID NO: 94423
  derived and/or modified sequence opt2 from hemagglutinin__InfluenzaA__AFK78187

SEQ ID NO: 100585 - RNA, 1701 nt, Artificial Sequence; identical to SEQ ID NO: 98367
  derived and/or modified sequence opt2 from hemagglutinin__InfluenzaA__AFM45476

SEQ ID NO: 100586 - RNA, 1701 nt, Artificial Sequence
  derived and/or modified sequence opt2 from hemagglutinin__InfluenzaA__AFM45487
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100587 - RNA, 1701 nt, Artificial Sequence; identical to SEQ ID NO: 98367
  derived and/or modified sequence opt2 from hemagglutinin__InfluenzaA__AFM45489

SEQ ID NO: 100588 - RNA, 1701 nt, Artificial Sequence; identical to SEQ ID NO: 100586
  derived and/or modified sequence opt2 from hemagglutinin__InfluenzaA__AFM45494

SEQ ID NO: 100589 - RNA, 1701 nt, Artificial Sequence
  derived and/or modified sequence opt2 from hemagglutinin__InfluenzaA__AFM68954
augaaggcccgccuccucguccuccucugcgcccucgccgccaccgacgccgacaccaucugcaucggcuaccacgccaacaacuccaccgacaccgucgacacccuccucgagaagaacgucaccgucacccacuccgucaaccuccucgaggacucccacaacggcaagcucugcaagcucaagggcaucgccccccuccagcucggcaagugcaacaucgccggcuggcuccucggcaaccccgagugcgacucccuccuccccgcccgcuccugguccuacaucgucgagacccccaacuccgagaacggcgccugcuaccccggcgacuucaucgacuacgaggagcucaaggagcagcucuccuccgucuccucccucgagcgcuucgagaucuuccccaaggaguccuccuggcccaaccacaacacccucaagggcgucaccgccuccugcucccacggcggcaaguccuccuucuaccgcaaccuccucuggcucaccaagaccgaggacuccuaccccaagcucuccaacuccuacgucaacaacaagggcaaggagguccucguccucuggggcguccaccaccccuccuccuccgacgagcagcagucccucuaccacaacgucaacgccuacgucuccgucgucuccuccaacuacaacggccgcuucacccccgagaucgccgcccgccccaagguccgcaaccagcccggccgcaugaacuacuacuggacccuccucgagcccggcgacaccaucaucuucgaggccaccggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccaguuccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucuccaaggaguucaacaaccucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagucccagcucaagaacaacgccaaggagaucggcaacggcugcuucgaguucuaccacaagugcgacaacaagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100590 - RNA, 1701 nt, Artificial Sequence
  derived and/or modified sequence opt2 from hemagglutinin__InfluenzaA__AFM68965
augaagaccaucaucgcccucuccuacaucuucugccagguccucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccuccggcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaaggccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100591 - RNA, 1701 nt, Artificial Sequence
  derived and/or modified sequence opt2 from hemagglutinin__InfluenzaA__AFM68987
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgacaaguccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100592 - RNA, 1701 nt, Artificial Sequence
  derived and/or modified sequence opt2 from hemagglutinin__InfluenzaA__AFM71720
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacgaguccgaguacaaguaccccgcccucaacgucgccaugcccaacaacggcaaguucgacaagcucuacaucuggggcguccaccaccccaucaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccucuucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100593 - RNA, 1701 nt, Artificial Sequence
  derived and/or modified sequence opt2 from hemagglutinin__InfluenzaA__AFM71731
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcgaguccuacgccugcaagcgcggcuccgucaaguccuucuucucccgccucaacuggcuccacaaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100594 - RNA, 1701 nt, Artificial Sequence
  derived and/or modified sequence opt2 from hemagglutinin__InfluenzaA__AFM71754
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgcccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100595 - RNA, 1701 nt, Artificial Sequence
  derived and/or modified sequence opt2 from hemagglutinin__InfluenzaA__AFM71768
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgcccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100596 - RNA, 1701 nt, Artificial Sequence
  derived and/or modified sequence opt2 from hemagglutinin__InfluenzaA__AFM71791
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgagcucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100597 - RNA, 1701 nt, Artificial Sequence
  derived and/or modified sequence opt2 from hemagglutinin__InfluenzaA__AFM71824
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100598 - RNA, 1701 nt, Artificial Sequence
  derived and/or modified sequence opt2 from hemagglutinin__InfluenzaA__AFM71835
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacuccgaguccuucaacuggaccggcgucacccagaacggcaccuccuccgccugcauccgccgcuccuacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucucccucgccaucuccugcuuccuccucugcgucgcccuccucggcuucaucaugugggccugccagaagggcaacauccgcugcaacaucugcaucuga

SEQ ID NO: 100599 - RNA, 1698 nt, Artificial Sequence
  derived and/or modified sequence opt2 from hemagglutinin__InfluenzaA__AFM71846
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccaccccuccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 100600 - RNA, 1701 nt, Artificial Sequence; identical to SEQ ID NO: 93830
  derived and/or modified sequence opt2 from hemagglutinin__InfluenzaA__AFM71857

SEQ ID NO: 100601 - RNA, 1701 nt, Artificial Sequence
  derived and/or modified sequence opt2 from hemagglutinin__InfluenzaA__AFM71868
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagauccgccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100602 - RNA, 1701 nt, Artificial Sequence; identical to SEQ ID NO: 98510
  derived and/or modified sequence opt2 from hemagglutinin__InfluenzaA__AFM71879

SEQ ID NO: 100603 - RNA, 1701 nt, Artificial Sequence
  derived and/or modified sequence opt2 from hemagglutinin__InfluenzaA__AFM71890
augaaggcccgccuccucguccuccucugcgcccucgccgccaccgacgccgacaccaucugcaucggcuaccacgccaacaacuccaccgacaccgucgacacccuccucgagaagaacgucaccgucacccacuccgucaaccuccucgaggacucccacaacggcaagcucugcaagcucaagggcaucgccccccuccagcucggcaagugcaacaucgccggcuggcuccucggcaaccccgagugcgacucccuccuccccgcccgcuccugguccuacaucgucgagacccccaacuccgagaacggcgccugcuaccccggcgacuucaucgacuacgaggagcucaaggagcagcucuccuccgucuccucccucgagcgcuucgagaucuuccccaaggaguccuccuggcccaaccacaacacccucaagggcgucaccgccuccugcucccacggcggcaaguccuccuucuaccgcaaccuccucuggcucaccaagaccgaggacuccuaccccaagcucuccaacuccuacgucaacaacaagggcaaggagguccucguccucuggggcguccaccaccccuccuccuccgacgagcagcagucccucuaccacaacgucaacgccuacgucuccgucgucuccuccaacuacaaccgccgcuucacccccgagaucgccgcccgccccaagguccgcaaccagcccggccgcaugaacuacuacuggacccuccucgagcccggcgacaccaucaucuucgaggccaccggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccaguuccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucuccaaggaguucaacaaccucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagucccagcucaagaacaacgccaaggagaucggcaacggcugcuucgaguucuaccacaagugcgacaacaagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100604 - RNA, 1701 nt, Artificial Sequence; identical to SEQ ID NO: 100589
  derived and/or modified sequence opt2 from hemagglutinin__InfluenzaA__AFM71901
